(12) United States Patent
Del'Guidice et al.

(10) Patent No.: US 12,286,632 B2
(45) Date of Patent: *Apr. 29, 2025

(54) RATIONALLY-DESIGNED SYNTHETIC PEPTIDE SHUTTLE AGENTS FOR DELIVERING POLYPEPTIDE CARGOS FROM AN EXTRACELLULAR SPACE TO THE CYTOSOL AND/OR NUCLEUS OF A TARGET EUKARYOTIC CELL, USES THEREOF, METHODS AND KITS RELATING TO SAME

(71) Applicant: Feldan Bio Inc., Québec (CA)

(72) Inventors: Thomas Del'Guidice, Québec (CA); Jean-Pascal Lepetit-Stoffaes, Québec (CA); David Guay, Québec (CA)

(73) Assignee: Feldan Bio Inc., Québec (CA)

(*) Notice: Subject to any disclaimer, the term of this patent is extended or adjusted under 35 U.S.C. 154(b) by 191 days.

This patent is subject to a terminal disclaimer.

(21) Appl. No.: 18/062,234

(22) Filed: Dec. 6, 2022

(65) Prior Publication Data

US 2023/0348537 A1    Nov. 2, 2023

Related U.S. Application Data

(63) Continuation of application No. 16/341,681, filed as application No. PCT/CA2017/051205 on Oct. 11, 2017, now Pat. No. 11,629,170, which is a continuation of application No. 15/666,139, filed on Aug. 1, 2017, now Pat. No. 9,982,267.

(60) Provisional application No. 62/535,015, filed on Jul. 20, 2017, provisional application No. 62/407,232, filed on Oct. 12, 2016.

(51) Int. Cl.
| | |
|---|---|
| C07K 7/08 | (2006.01) |
| A61K 39/395 | (2006.01) |
| C07K 14/00 | (2006.01) |
| C07K 14/47 | (2006.01) |
| C07K 16/00 | (2006.01) |
| C07K 16/18 | (2006.01) |
| C07K 16/46 | (2006.01) |
| C07K 17/06 | (2006.01) |
| C12N 9/22 | (2006.01) |
| C12N 15/11 | (2006.01) |
| C12N 15/62 | (2006.01) |
| C12N 15/87 | (2006.01) |
| C12N 15/90 | (2006.01) |
| C12Q 1/68 | (2018.01) |
| A61K 38/00 | (2006.01) |

(52) U.S. Cl.
CPC ............ *C12N 15/62* (2013.01); *A61K 39/395* (2013.01); *C07K 7/08* (2013.01); *C07K 14/00* (2013.01); *C07K 14/4705* (2013.01); *C07K 16/00* (2013.01); *C07K 16/18* (2013.01); *C07K 16/46* (2013.01); *C07K 17/06* (2013.01); *C12N 9/22* (2013.01); *C12N 15/11* (2013.01); *C12N 15/90* (2013.01); *A61K 38/00* (2013.01); *C07K 2319/01* (2013.01); *C07K 2319/02* (2013.01); *C07K 2319/03* (2013.01); *C07K 2319/09* (2013.01); *C07K 2319/10* (2013.01); *C07K 2319/70* (2013.01); *C12N 2310/20* (2017.05)

(58) Field of Classification Search
CPC ...... C07K 7/08; C07K 14/00; C07K 14/4705; C07K 16/00; C07K 16/18; C07K 16/46; C07K 17/06
See application file for complete search history.

(56) References Cited

U.S. PATENT DOCUMENTS

| | | |
|---|---|---|
| 7,084,248 B2 | 8/2006 | Summerton |
| 7,579,318 B2 | 8/2009 | Divita et al. |
| 8,242,081 B2 | 8/2012 | Divita et al. |
| 9,738,687 B2 | 8/2017 | Guay et al. |

(Continued)

FOREIGN PATENT DOCUMENTS

| | | |
|---|---|---|
| CA | 3040645 A1 | 10/2020 |
| WO | WO-2015038662 A1 | 3/2015 |

(Continued)

OTHER PUBLICATIONS

Kawczyński, M.T., et al. (2013 Ph.D. Interdiscip. J.: pp. 31-36) (Year: 2013).*

(Continued)

*Primary Examiner* — Marsha Tsay
(74) *Attorney, Agent, or Firm* — WILSON SONSINI GOODRICH & ROSATI

(57) ABSTRACT

The present description relates to methods for delivering polypeptide cargos from an extracellular space to the cytosol and/or nucleus of a target eukaryotic cell. The methods involve contacting the cell with the polypeptide cargo in the presence of a peptide shuttle agent at a concentration sufficient to increase the polypeptide cargo's transduction efficiency. Also described here are parameters that may be used in the rational design of such synthetic peptide shuttle agents, peptide shuttle agents that satisfy one or more of these design parameters, as well as methods and compositions relating to the use of the synthetic peptide shuttle agents for delivery of a variety of polypeptide cargos (such as transcription factors, antibodies, CRISPR-associated nucleases and functional genome editing complexes) from an extracellular space to the cytosol and/or nucleus of target eukaryotic cells. Applications and targets for genome-editing NK cells for improved immunotherapy are also described.

20 Claims, 58 Drawing Sheets

Specification includes a Sequence Listing.

(56) References Cited

U.S. PATENT DOCUMENTS

| | | | |
|---|---|---|---|
| 9,982,267 | B2 | 5/2018 | Del'Guidice et al. |
| 10,633,421 | B2 | 4/2020 | Guay et al. |
| 11,629,170 | B2 | 4/2023 | Del'Guidice et al. |
| 12,060,387 | B2 | 8/2024 | Guay et al. |
| 2003/0104622 | A1 | 6/2003 | Robbins et al. |
| 2007/0054401 | A1 | 3/2007 | Prochiantz et al. |
| 2015/0071903 | A1 | 3/2015 | Liu et al. |
| 2022/0204561 | A1 | 6/2022 | Guay et al. |
| 2023/0383291 | A1 | 11/2023 | Lepetit-Stoffaes et al. |
| 2023/0399661 | A1 | 12/2023 | Guay et al. |
| 2024/0197896 | A1 | 6/2024 | Soultan et al. |

FOREIGN PATENT DOCUMENTS

| | | | |
|---|---|---|---|
| WO | WO-2015089462 | A1 | 6/2015 |
| WO | WO-2016052442 | A1 | 4/2016 |
| WO | WO-2016161516 | A1 | 10/2016 |
| WO | WO-2017049407 | A1 | 3/2017 |
| WO | WO-2017175072 | A1 | 10/2017 |
| WO | WO-2018053632 | A1 | 3/2018 |
| WO | WO-2018068135 | A1 | 4/2018 |
| WO | WO-2020016242 | A1 | 1/2020 |
| WO | WO-2020210916 | A1 | 10/2020 |
| WO | WO-2022077121 | A1 | 4/2022 |
| WO | WO-2022082315 | A1 | 4/2022 |
| WO | WO-2022204806 | A1 | 10/2022 |

OTHER PUBLICATIONS

Aguila et al.: SALL4 is a robust stimulator for the expansion of hematopoietic stem cells. Blood 118(3):576-585 (2011).

Ain et al.: Effects of protein transduction domain (PTD) selection and position for improved intracellular delivery of PTD-Hsp27 fusion protein formulations. Arch. Pharm. Res. 39:1266-1274 (2016).

Akinci et al.: Reprogramming of pancreatic exocrine cells towards a beta (beta) cell character using Pdx1, Ngn3 and MafA. Biochem J. 442(3):539-550 (2012).

Akishiba et al., Cytosolic antibody delivery by lipid-sensitive endosomolytic peptide. Nat Chem. Aug. 2017;9(8):751-761 (2017). doi: 10.1038/nchem.2779. Epub May 22, 2017. PMID: 28754944.

Akishiba et al., Inducible Membrane Permeabilization by Attenuated Lytic Peptides: A New Concept for Accessing Cell Interiors through Ruffled Membranes. Mol Pharm. 16(6):2540-2548 (2019).

Alford et al.: Toxicity of organic fluorophores used in molecular imaging: literature review. Mol Imaging. 8(6):341-354 (2009).

Amand, Helene L. et al. Functionalization with C-terminal cysteine enhances transfection efficiency of cell-penetrating peptides through dimer formation. Biochemical and Biophysical Research Communications 418(3):469-474 (2012).

Andreu, David. et al. Shortened cecropin A-melittin hybrids Significant size reduction retains potent antibiotic activity. FEBS Letters 296(2):190-194 (1992).

Aoukaty et al.: Role for glycogen synthase kinase-3 in NK cell cytotoxicity and X-linked lymphoproliferative disease. J Immunol 174:4551-4558 (2005).

Barrangou et al.: CRISPR-Cas Systems: Prokaryotes Upgrade to Adaptive Immunity. Mod. Cell 54(2):234-244 (2014).

Bejarano et al.: Motif trap:A rapid method to clone motifs that can target proteins to defined subcellular localisations. J Cell Sci. 112(Pt 23):4207-4211 (1999).

Bikard, David. et al. Programmable repression and activation of bacterial gene expression using an engineered CRISPR-Cas system. Nucleic Acids Res 41(15):7429-7437 (2013).

Boman, H G. et al. Antibacterial and antimalarial properties of peptides that are cecropin-melittin hybrids. FEBS Letters 259(1):103-106 (1989).

Braud et al.: HLA-E binds to natural killer cell receptors CD94/NKG2A, B and C. Nature 391:795-799 (1998).

Brock et al.: Efficient cell delivery mediated by lipid-specific endosomal escape of supercharged branched peptides; Traffic; 19:421-435 (2018).

Buganim et al.: The Developmental Potential of iPSCs Is Greatly Influenced by Reprogramming Factor Selection. Cell stem cell. 15:295-309 (2014).

Burstein, David. et al. New CRISPR-Cas systems from Uncultivated Microbes. Nature 542(7640):237-241 (2017).

Cardarelli et al.: Quantitative Analysis of Tat Peptide Binding to Import Carriers Reveals Unconventional Nuclear Transport Properties. The Journal of Biological Chemistry. 286(14):12292-12299 (2011).

Chan et al.: Enhancement of MSH receptor- and GAL4-mediated gene transfer by switching the nuclear import pathway. Gene Ther 8(2):166-171 (2001).

Chan et al.: Enhancement of polylysine-mediated transferrinfection by nuclear localization sequences: polylysine does not function as a nuclear localization sequence. Hum Gene Ther. 10(10):1695-1702 (1999).

Chance, Deborah L, and Thomas P. Mawhinney. Observations of, and Insights into, Cystic Fibrosis Mucus Heterogeneity in the Pre-Modulator Era: Sputum Characteristics, DNA and Glycoprotein Content, and Solubilization Time. Journal of Respiration 1(1):8-29 (2021).

Chang et al., CD13 (aminopeptidase N) can associate with tumor-associated antigen L6 and enhance the motility of human lung cancer cells. Int J Cancer. 116(2):243-252 (2005).

Chang et al.: Cellular Internalization of Fluorescent Proteins via Arginine-rich Intracellular Delivery Peptide in Plant Cells; Plant Cell Physiol.; 46(3):482-488 (2005).

Cong, Le. et al. Multiplex Genome Engineering using CRISPR/Cas systems. Science 339(6121): pp. 819-823 (2013).

Cooper et al.: The biology of human natural killer-cell subsets. Trends Immunol 22:633-640 (Abstract) (2001).

Cornut et al., The amphipathic alpha-helix concept. Application to the de novo design of ideally amphipathic Leu, Lys peptides with hemolytic activity higher than that of melittin. FEBS Lett. 349(1):29-33 (1994).

Co-pending U.S. Appl. No. 18/553,178, inventors Soultan; Al-Halifa et al., filed Sep. 28, 2023.

Cox, David Benjamin Turitz. et al. Therapeutic Genome Editing: Prospects and Challenges. Nature Medicine 21(2):121-131 (2015).

Crombez et al.: A New Potent Secondary Amphipathic Cell-penetrating Peptide for siRNA Delivery Into Mammalian Cells. Molecular Therapy. 17(1): 95-103 (2009).

De Kruijf et al.: HLA-E and HLA-G expression in classical HLA class I-negative tumors is of prognostic value for clinical outcome of early breast cancer patients. J Immunol 185:7452-7459 (2010).

Delconte et al.:, CIS is a potent checkpoint in NK cell-mediated tumor immunity. Nat Immunol. 17(7):816-824 (2016).

Del'Guidice et al.: Intrabody Delivery—The Feldan Shuttle Technology: A Peptide-Based Method to Deliver Antibodies. Drug Development & Delivery. 18(1):28-32 (2018).

Del'Guidice, Thomas. et al. Membrane Permeabilizing Amphiphilic Peptide Delivers Recombinant Transcription Factor and CRISPR-Cas9/Cpf1 ribonucleoproteins in Hard-to-modify Cells. PLOS One 13(4):e0195558, 1-26 (2018).

Denman et al.: Membrane-bound IL-21 promotes sustained ex vivo proliferation of human natural killer cells. PLoS One 7:e30264 (2012).

Deshayes et al.: Structural polymorphism of non-covalent peptide-based delivery systems: Highway to cellular uptake. Biochimica et Biophysica Acta 1798:2304-2314 (2010).

Dolfini et al.: The short isoform of NF-YA belongs to the embryonic stem cell transcription factor circuitry. Stem Cells. 30(11):2450-2459 (2012).

Drin, Guillaume. et al. Studies on the internalization mechanism of cationic cell-penetrating peptides. Journal of Biological Chemistry 278(33):31192-31201 (2003).

Ebina et al.: Transcription factor-mediated reprogramming toward hematopoietic stem cells. EMBO Journal. 34(6):694-709 (2015).

Eisenberg, David. et al. The helical hydrophobic moment: a measure of the amphiphilicity of a helix. Nature 299(5881):371-374 (1982). Abstract Only.

(56) References Cited

OTHER PUBLICATIONS

El-Andaloussi, Samir. et al. A novel cell-penetrating peptide, M918, for efficient delivery of proteins and peptide nucleic acids. Molecular Therapy 15(10):1820-1826 (2007).
Elmquist, Anna. et al. VE-cadherin-derived cell-penetrating peptide, pVEC, with carrier functions. Experimental Cell Research 269(2):237-244 (2001).
El-Sayed, Ayman. et al. Delivery of macromolecules using arginine-rich cell-penetrating peptides: ways to overcome endosomal entrapment. The AAPS Journal 11(1):13-22 (2009).
Erazo-Oliveras, Alfredo. et al. Protein delivery into live cells by incubation with an endosomolytic agent. Nature Methods 11(8):861-867 (2014).
Erazo-Oliveras, et al.; "Improving the Endosomal Escape of Cell-Penetrating Peptides and Their Cargos: Strategies and Challenges"; Pharmaceuticals; vol. 5, pp. 1177-1209 (2012).
Fanara et al.: Quantitative analysis of nuclear localization signal (NLS)-importin alpha interaction through fluorescence depolarization. Evidence for auto-inhibitory regulation of NLS binding. J Biol Chem. 275(28):21218-21223 (2000).
Farkhani, Samad Mussa. et al. Cell penetrating peptides: efficient vectors for delivery of nanoparticles, nanocarriers, therapeutic and diagnostic molecules. Peptides 57:78-94 (2014).
Fasoli et al.: Mechanistic insight into CM18-Tat11 peptide membrane-perturbing action by whole-cell patch-clamp recording. Molecules. 19(7):9228-9239 (2014).
Fawell, Stephen. et al. Tat-mediated delivery of heterologous proteins into cells. Proceedings of the National Academy of Sciences 91(2):664-668 (1994).
Firas et al.: Transcription factor-mediated reprogramming: epigenetics and therapeutic potential. Immunology and Cell Biology. 93(3):284-289 (2015).
Fominaya, J. et al. A chimeric fusion protein containing transforming growth factor-α mediates gene transfer via binding to the EGF receptor. Gene Therapy 5(4):521-530 (1998).
Fominaya, Jesus, and Winfried Wels. Target Cell-specific DNA Transfer Mediated by a Chimeric Multidomain Protein. Novel non-viral gene delivery system. Journal of Biological Chemistry 271(18):10560-10568 (1996).
Fonoudi et al.: ISL1 protein transduction promotes cardiomyocyte differentiation from human embryonic stem cells. PLoS One 8(1):e55577 (2013).
Ford et al.: Protein transduction: an alternative to genetic intervention? Gene Ther. 8(1):1-4 (2001).
Forman, Henry Jay. et al. Glutathione: Overview Of Its Protective Roles, Measurement, And Biosynthesis. Molecular Aspects of Medicine 30(1-2):1-12 (2009). Published online Aug. 30, 2008.
Fujita et al.: Applications of Engineered DNA-Binding Molecules Such as TAL Proteins and the CRISPR/Cas System in Biology Research. International Journal of Molecular Sciences. 16(10):23143-23164 (2015).
Gao, Feng. et al. DNA-guided genome editing using the Natronobacterium gregoryi Argonaute. Nature Biotechnology 34(7):768-773 (2016).
Gentilucci, Luca. et al. Chemical Modifications Designed to Improve Peptide Stability: Incorporation of Non-natural Amino Acids, Pseudopeptide Bonds, and Cyclization. Current Pharmaceutical Design 16(28):3185-3203 (2010).
Giguère et al.: Machine learning assisted design of highly active peptides for drug discovery. PLoS Comput Biol. 11(4):e1004074 (2015).
Gilbert et al., CRISPR-Mediated modular RNA-guided regulation of transcription in Eukaryotes. Cell 154(2): 442-451 (2013).
Gilmore et al.: v-rel oncoproteins in the nucleus and in the cytoplasm transform chicken spleen cells. J Virol 62(3):703-714 (1988).
Giustarini, Daniela. et al. Assessment Of Glutathione/Glutathione Disulphide Ratio And S-Glutathionylated Proteins In Human Blood, Solid Tissues, And Cultured Cells. Free Radical Biology and Medicine 112:360-375 (2017).
Glover, Dominic J. et al. Multifunctional protein nanocarriers for targeted nuclear gene delivery in nondividing cells. The FASEB Journal 23(9):2996-3006 (2009).
Gomez-Cabrero et al.: Use of transduction proteins to target trabecular meshwork cells: outflow modulation by profilin I. Molecular Vision. 11:1071-1082 (2005).
Gordon et al.: The transcription factors T-bet and Eomes control key checkpoints of natural killer cell maturation. Immunity. 36(1):55-67 (2012).
Gottschalk, Sparrow. et al. A novel DNA-peptide complex for efficient gene transfer and expression in mammalian cells. Gene Therapy 3(5):448-457 (1996).
Gould et al.: A conserved tripeptide sorts proteins to peroxisomes. J Cell Biol 108(5):1657-1664 (1989).
Green, Maurice, and Paul M. Loewenstein. Autonomous functional domains of chemically synthesized human immunodeficiency virus tat trans-activator protein. Cell 55(6):1179-1188 (1988).
Grimes et al.: Endocytosis of activated TrkA: evidence that nerve growth factor induces formation of signaling endosomes. J Neurosci 16(24):7950-7964 (1996).
Guo et al., High LIFr expression stimulates melanoma cell migration and is associated with unfavorable prognosis in melanoma. Oncotarget. 6(28):25484-25498(2015).
Guo, Zhang-Yan. et al. Predictive value of HLA-G and HLA-E in the Prognosis of Colorectal Cancer Patients. Cellular Immunology 293:10-16 (2016). Published Online Oct. 28, 2014.
Hallbrink, Mattias. et al. Cargo delivery kinetics of cell-penetrating peptides. Biochimica et Biophysica Acta 1515(2):101-109 (2001).
Herce, Henry D, and Angel E. Garcia. Molecular dynamics simulations suggest a mechanism for translocation of the HIV-1 TAT peptide across lipid membranes. Proceedings of the National Academy of Sciences 104(52):20805-20810 (2007).
Ho, Alan. et al. Synthetic protein transduction domains: enhanced transduction potential in vitro and in vivo. Cancer Research 61(2):474-477 (2001).
Horng et al.: NKG2D signaling is coupled to the interleukin 15 receptor signaling pathway. Nat Immunol 8:1345-1352 (2007).
Hou et al.: Transdermal delivery of proteins mediated by non-covalently associated arginine-rich intracellular delivery peptides; Experimental Dermatology; 16:999-1006 (2007).
Hsu et al. Development and applications of CRISPR-Cas9 for genome engineering. Cell 157(6):1262-1278 (2014).
Hurt et al.: The first twelve amino acids (less than half of the pre-sequence) of an imported mitochondrial protein can direct mouse cytosolic dihydrofolate reductase into the yeast mitochondrial matrix. Embo J. 4(8):2061-2068 (1985).
Ichii, Hirohito. et al. Bcl6 acts as an Amplifier for the Generation and Proliferative Capacity of Central Memory CD8+ T cells. Journal of Immunology 173(2):883-891 (2004).
IL Patent Application No. IL265920 Office Action dated Jul. 25, 2022.
Ilfeld, Brian M, and Tony L. Yaksh. The end of postoperative pain-a fast-approaching possibility? and, if so, will we be ready?. Regional Anesthesia & Pain Medicine 34(2):85-87 (2009).
Irie et al.: Molecular cloning and characterization of Amida, a novel protein which interacts with a neuron-specific immediate early gene product arc, contains novel nuclear localization signals, and causes cell death in cultured cells. J Biol Chem 275(4):2647-2653 (2000).
Ishigami, Sumiya. et al. Human Leukocyte antigen (HLA)-E and HLA-F Expression in Gastric Cancer. Anticancer Research 35(4):2279-2285 (2015).
Iwasaki et al.: Cellular uptake and in vivo distribution of polyhistidine peptides. Journal of Controlled Release. 210:115-124 (2015).
Jinek et al.: Bacterial Immunity A Programmable Dual-RNA-Guided DNA Endonuclease in Adaptive. Science. 337(6096):816-821 (2012).
Järver et al., Peptide nanoparticle delivery of charge-neutral splice-switching morpholino oligonucleotides. Nucleic Acid Ther. 25(2):65-77 (2015).
Kabouridis: Biological applications of protein transduction technology. Trends in Biotechnology. 21(11):498-503 (2003).

(56) References Cited

OTHER PUBLICATIONS

Kadkhodayan et al.: Generation of GFP Native Protein for Detection of Its Intracellular Uptake by Cell-Penetrating Peptides. Folia Biologica (Praha). 62, 103-109 (2016).
Kakudo, Tomoyuki. et al. Transferrin-modified liposomes equipped with a pH-sensitive fusogenic peptide: an artificial viral-like delivery system. Biochemistry 43(19):5618-5628 (2004).
Karniely et al.: Single translation—dual destination: mechanisms of dual protein targeting in eukaryotes. EMBO Rep 6(5):420-425 (2005).
Kato et al.: Max: functional domains and interaction with c-Myc. Genes Dev. 6(1):81-92 (1992).
Keller et al.: Relationships between Cargo, Cell Penetrating Peptides and Cell Type for Uptake of Non-Covalent Complexes into Live Cells. Pharmaceuticals. 6: 184-203 (2013) doi:10.3390/ph6020184.
Keller et al.: Transduction of Proteins into Leishmania Tarentolae by Formation of Non-Covalent Complexes with Cell-Penetrating Peptides. Journal of Cellular Biochemistry. 115:243-252 (2014).
Kichler, Antoine. et al. Cationic amphipathic histidine-rich peptides for gene delivery. Biochimica et Biophysica Acta 1758(3):301-307 (2006).
Kichler, Antoine. et al. Histidine-rich amphipathic peptide antibiotics promote efficient delivery of DNA into mammalian cells. Proceedings of the National Academy of Sciences 100(4):1564-1568 (2003).
Kirwan et al.: Killer cell Ig-like receptor-dependent signaling by Ig-like transcript 2 (ILT2/CD85j/LILRB1/LIR-1). J Immunol 175:5006-5015 (2005).
Kleinschmidt et al.: Identification of domains involved in nuclear uptake and histone binding of protein N1 of Xenopus laevis. EMBO J, 7(6):1605-1614 (1988).
Kohler et al.: Adenoviral E1A protein nuclear import is preferentially mediated by importin alpha3 in vitro. Virology 289(2):186-191 (2001).
Krishnamurthy, Anuradha. et al. Bispecific Antibodies for Cancer Therapy: a review. Pharmacology & therapeutics 185:122-134 (2018). Published Online Dec. 18, 2017.
Krishnamurthy, Sateesh. et al. Engineered Amphiphilic Peptides Enable Delivery Of Proteins And CRISPR-Associated Nucleases To Airway Epithelia. Nature Communications 10(1):4906, 1-12 (2019).
Kumar, Sumit. et al., PEGylation and Cell-Penetrating Peptides: Glimpse into the Past and Prospects in the Future. Current Topics in Medicinal Chemistry 20(5):337-348 (2020).
Kurzawa et al.: PEP and CADY-mediated delivery of fluorescent peptides and proteins into living cells. Biochimica et Biophysica Acta. 1798: 2274-2285 (2010).
Kwon, Ester J. et al. A truncated HGP peptide sequence that retains endosomolytic activity and improves gene delivery efficiencies. Molecular Pharmaceutics 7(4):1260-1265 (2010).
Kwon et al., Antitumor effect of a transducible fusogenic peptide releasing multiple proapoptotic peptides by caspase-3. Mol Cancer Ther. 7(6):1514-1522 (2008).
Lamiable, Alexis. et al. PEP-FOLD3: faster de novo structure prediction for linear peptides in solution and in complex. Nucleic Acids Research 44(W1):W449-W454 (2016).
Lanford et al.: Induction of nuclear transport with a synthetic peptide homologous to the SV40 T antigen transport signal. Cell 46(4):575-582 (1986).
Lee et al.: Activatable Cell Penetrating Peptide—Peptide Nucleic Acid Conjugate via Reduction of Azobenzene PEG Chains. J. Am. Chem. Soc. 136:12868-12871 (2014).
Lee, et al.; "Delivery of macromolecules into live cells by simple co-incubation with a peptide"; ChemBioChem; vol. 11, No. 3, pp. 325-330 (Feb. 15, 2010).
Lee, Ni. et al. HLA-E is a Major ligand for the Natural Killer Inhibitory Receptor CD94/NKG2A. Proceedings of the National Academy of Sciences of the United States of America 95(9):5199-5204 (1998).
Levy et al.: Human leukocyte antigen-E protein is overexpressed in primary human colorectal cancer. Int J Oncol 32:633-641 (2008).
Li et al.: Delivery of intracellular-acting biologics in pro-apoptotic therapies. Current Pharmaceutical Design. 17(3):293-319 (2011).
Li, Weijun. et al. GALA: a designed synthetic pH-responsive amphipathic peptide with applications in drug and gene delivery. Advanced Drug Delivery Reviews 56(7):967-985 (2004).
Lin et al.: B lymphocyte-induced maturation protein 1 (BLIMP-1) attenuates autoimmune diabetes in NOD mice by suppressing Th1 and Th17 cells. Diabetologia 56(1):136-146 (2013).
Lin et al.: HLA-G expression in human ovarian carcinoma counteracts NK cell function. Annals of Oncology. 18:1804-1809 (2007).
Liou, et al.; "Protein transduction in human cells is enhanced by cell-penetrating peptides fused with an endosomolytic HA2 sequence"; Peptides; vol. 37, pp. 273-284 (2012).
Liu et al, Cell-Penetrating Peptide-Mediated Delivery of TALEN Proteins via Bioconjugation for Genome Engineering, PLOS One, 2014, vol. 9(1), pp. 1-7.
Liu et al.: E3 ubiquitin ligase Cbl-b in innate and adaptive immunity. Cell Cycle 13:1875-1884 (2014).
Liu et al.: Intracellular delivery of quantum dots mediated by a histidine- and arginine-rich HR9 cell-penetrating peptide through the direct membrane translocation mechanism; Biomaterials; 32:3520-3537 (2011).
Liu et al.: Systemic genetic transfer of p21WAF-1 and GM-CSF utilizing of a novel oligopeptide-based EGF receptor targeting polyplex. Cancer Gene Ther. 10(7):529-539 (2003).
Lo et al.: An endosomolytic Tat peptide produced by incorporation of histidine and cysteine residues as a nonviral vector for DNA transfection. ScienceDirect, Biomaterials. 29:2408-2414 (2008).
Loeser et al.: Spontaneous tumor rejection by cbl-b-deficient CD8+ T cells. J Exp Med 204:879-891 (2007).
London, Erwin. Diphtheria toxin: membrane interaction and membrane translocation. Biochimica et Biophysica Acta 1113(1):25-51 (1992).
Lord-Dufour et al.: Evidence for transcriptional regulation of the glucose-6-phosphate transporter by HIF-1alpha: Targeting G6PT with mumbaistatin analogs in hypoxic mesenchymal stromal cells. Stem cells. 27:489-497 (2009).
Lorieau, Justin L. et al. The complete influenza hemagglutinin fusion domain adopts a tight helical hairpin arrangement at the lipid: water interface. Proceedings of the National Academy of Sciences 107(25):11341-11346 (2010).
Lu et al.: Recombinant HoxB4 fusion proteins enhance hematopoietic differentiation of human embryonic stem cells. Stem Cells Dev 16(4):547-559 (2007).
Luan, Liang. et al. Peptide amphiphiles with multifunctional fragments promoting cellular uptake and endosomal escape as efficient gene vectors. Journal of Materials Chemistry B 3(6):1068-1078 (2015). Published Online Dec. 17, 2014.
Lutz-Nicoladoni et al.: Modulation of Immune Cell Functions by the E3 Ligase Cbl-b. Front Oncol 5:58 (2015).
Mack et al.: Aminooxypentane-RANTES induces CCR5 internalization but inhibits recycling: a novel inhibitory mechanism of HIV infectivity. J Exp Med, 187(8):1215-1224 (1998).
Maeng et al.: Effects of single nucleotide polymorphisms on treatment outcomes and toxicity in patients treated with sunitinib. Anticancer Res 33(10):4619-4626 (2013).
Mahlum, Eric. et al. Engineering a noncarrier to a highly efficient carrier peptide for noncovalently delivering biologically active proteins into human cells. Analytical Biochemistry 365(2):215-221 (2007).
Makarova et al.: Unification of Cas protein families and a simple scenario for the origin and evolution of CRISPR-Cas systems. Biol Direct. 6:38 (2011).
Makarova, Kira S. et al. Evolution and Classification of the CRISPR-Cas Systems. Nature reviews. Microbiology 9(6):467-477 (2011).
Makkerh et al.: Comparative mutagenesis of nuclear localization signals reveals the importance of neutral and acidic amino acids. Curr Biol. Aug. 1, 1996;6(8):1025-1027. doi:10.1016/s0960-9822(02)00648-6.
Martinez-Fong et al.: Neurotensin-SPDP-poly-L-lysine conjugate: a nonviral vector for targeted gene delivery to neural cells. Brain Res Mol Brain Res. 69(2):249-262 (1999).

(56) References Cited

OTHER PUBLICATIONS

Matalon et al.: (2016). Dephosphorylation of the adaptor LAT and phospholipase C-gamma by SHP-1 inhibits natural killer cell cytotoxicity. Sci Signal 9:ra54 (2016).
Maurer et al.: Macrophage inflammatory protein-1. Int J Biochem Cell Biol. 36(10): 1882-1886 (2004).
McKay et al.: Secretin-mediated gene delivery, a specific targeting mechanism with potential for treatment of biliary and pancreatic disease in cystic fibrosis. Mol Ther 5(4): 447-454 (2002).
Midoux, Patrick. et al. Membrane permeabilization and efficient gene transfer by a peptide containing several histidines. Bioconjugate Chemistry 9(2):260-267 (1998).
Milenkovic et al.: Identification of the signal directing Tim9 and Tim10 into the intermembrane space of mitochondria. Mol Biol Cell 20(10):2530-2539 (2009).
Mitchell, Dennis J. et al. Polyarginine Enters Cells More Efficiently Than Other Polycationic Homopolymers. The Journal of Peptide Research 56(5):318-325 (2000).
Miyoshi et al.: [Structure and regulation of human thyroid-stimulating hormone (TSH) gene]. Nihon Rinsho 52(4) [Abstract] (1994).
Moede et al.: Identification of a nuclear localization signal, RRMKWKK, in the homeodomain transcription factor PDX-1. FEBS Lett 461(3):229-234 (1999).
Mol, A. R. et al. NetWheels: A Web Application to Create High Quality Peptide Helical Wheel and Net Projections. Posted Sep. 14, 2018.
Montrose, Kristopher. et al. Xentry, a new class of cell-penetrating peptide uniquely equipped for delivery of drugs. Scientific Reports 3(1):1661, 1-7 (2013).
Moreland et al.: Amino acid sequences that determine the nuclear localization of yeast histone 2B. Mol Cell Biol 7(11):4048-4057 (1987).
Morris et al., A non-covalent peptide-based carrier for in vivo delivery of DNA mimics. Nucleic Acids Res. 2007;35(7):e49, pp. 1-10 (2007).
Morris, M C. et al. Combination of a new generation of PNAs with a peptide-based carrier enables efficient targeting of cell cycle progression. Gene Therapy 11(9):757-764 (2004).
Morris, May C. et al. A peptide carrier for the delivery of biologically active proteins into mammalian cells. Nature Biotechnology 19(12):1173-1176 (2001).
Moulton HM: In vivo delivery of morpholino oligos by cell-penetrating peptides. Curr. Pharm. Des. 19(16):2963-9 (2013).
Mussbach et al.: Transduction of Peptides and Proteins Into Live Cells by Cell Penetrating Peptides. Journal of Cellular Biochemistry. 112: 3824-3833 (2011).
Nagahara, et al. Transduction of Full-length TAT Fusion Proteins Into Mammalian Cells: TAT-p27kip1 Induces Cell Migration. Nature Medicine 4(12):1449-1452 (1998).
Nakanishi et al.: Interaction of the Vp3 nuclear localization signal with the importin alpha 2/beta heterodimer directs nuclear entry of infecting simian virus 40. J Virol, 76(18):9368-9377 (2002).
Nitzki, Frauke et al., Patched Knockout Mouse Models of Basal Cell Carcinoma. Journal of Skin Cancer. 2012:907543 pp. 1-11 (2012).
Nomura et al., Improved cytosolic delivery of macromolecules through dimerization of attenuated lytic peptides. Bioorg Med Chem Lett. 30(17):127362, pp. 1-5 (2020).
O'Keefe, Donald O. Characterization of a full-length, active-site mutant of diphtheria toxin. Archives of Biochemistry and Biophysics 296(2):678-684 (1992).
Paolino et al.: The E3 ligase Cbl-b and TAM receptors regulate cancer metastasis via natural killer cells. Nature 507:508-512 (2014).
Parameswaran et al.: Repression of GSK3 restores NK cell cytotoxicity in AML patients. Nat Commun 7:11154 (2016).
Parente, Roberta A. et al. Mechanism of leakage of phospholipid vesicle contents induced by the peptide GALA. Biochemistry 29(37):8720-8728 (1990).
Patel et al.: Glycogen Synthase Kinase 3: A Kinase for All Pathways? Curr Top Dev Biol 123:277-302 (2017).
Paul et al.: Gene transfer using a novel fusion protein, GAL4/invasin.Hum Gene Ther,8(10):1253-1262 (1997).
PCT/CA2017/051205 International Search Report and Written Opinion dated Jan. 24, 2018.
PCT/CA2020/050517 International Preliminary Report on Patentability dated Oct. 28, 2021.
PCT/CA2020/050517 International Search Report and Written Opinion dated Jul. 17, 2020.
PCT/CA2021/051458 International Search Report and Written Opinion dated Jan. 25, 2022.
PCT/CA2021/051490 International Search Report and Written Opinion mailed on Jan. 24, 2022.
PCT/CA2022/050472 International Search Report and Written Opinion dated Jul. 4, 2022.
PCT/CA2022/050472 Invitation to Pay Additional Fees dated May 5, 2022.
PCT/IB2017/000512 International Search Report and Written Opinion dated Jul. 26, 2017.
Perez, F. et al. Antennapedia homeobox as a signal for the cellular internalization and nuclear addressing of a small exogenous peptide. Journal of Cell Science 102(Pt 4):717-722 (1992).
Pimenta et al.: Alpha1-antichymotrypsin and kallistatin hydrolysis by human cathepsin D.J Protein Chem, 19(5):411-418 (2000).
Poli et al.: CD56bright natural killer (NK) cells: an important NK cell subset. Immunology 126:458-465 (2009).
Premsirut et al., A Rapid and Scalable System for Studying Gene Function in Mice Using Conditional RNA Interference. Cell. 145:145-158 (2011).
Prieve et al.: Nuclear localization and formation of beta-catenin-lymphoid enhancer factor 1 complexes are not sufficient for activation of gene expression. Mol Cell Biol, 19(6):4503-4515 (1999).
Rajagopalan et al.: Recombinant fusion proteins TAT-Mu, Mu and Mu-Mu mediate efficient non-viral gene delivery. J Gene Med, 9(4):275-286 (2007).
Ramakrishna et al. Gene disruption by cell-penetrating peptide-mediated delivery of Cas9 protein and guide RNA. Genome Research 24:1020-1027 (2014).
Ramsey, Joshua D, and Nicholas H. Flynn. Cell-penetrating peptides transport therapeutics into cells. Pharmacology & Therapeutics 154:78-86 (2015).
Regalado: Who owns the biggest biotech discover of the century?. MIT Technology Review. 4 pages (2014).
Riddell et al.: Reprogramming committed murine blood cells to induced hematopoietic stem cells with defined factors. Cell, 157:549-564 (2014).
Salomone et al.: High-Yield nontoxic gene transfer through conjugation of the CM18-Tat11 chimeric peptide with nanosecond electric pulses. Molecular Pharmaceutics. 9 pages (2014) available at: http://pubs.acs.org.
Salomone et al.: In vitro efficient transfection by CM18-Tat11 hybrid peptide: a new tool for gene-delivery applications. PLoS One 8(7):e70108, 11 pages (2013).
Salomone, Fabrizio. et al. A novel chimeric cell-penetrating peptide with membrane-disruptive properties for efficient endosomal escape. Journal of Controlled Release 163(3):293-303 (2012).
Sampson et al.: Exploiting CRISPR/Cas systems for biotechnology. Bioessays. 36(1):34-38 (2014).
Sato et al.: Peptide-membrane interactions and mechanisms of membrane destruction by amphipathic α-helical antimicrobial peptides. Biochimica et Biophysica Acta 1758:1245-1256 (2006).
Schiffer, Marianne, and Allen B. Edmundson. Use of Helical Wheels to represent the Structures of Proteins and to Identify Segments with Helical Potential. Biophysical Journal 7(2):121-135 (1967).
Schneider et al.: A novel peptide, Plaeidgielty, for the targeting of alpha9beta1-integrins.FEBS Lett. 429(3):269-273 (1998).
Schreiber et al.: The human poly(ADP-ribose) polymerase nuclear localization signal is a bipartite element functionally separate from DNA binding and catalytic activity. EMBO J. 11(9):3263-3269 (1992).

(56) References Cited

OTHER PUBLICATIONS

Schuster, Martin J. et al. Multicomponent DNA carrier with a vesicular stomatitis virus G-peptide greatly enhances liver-targeted gene expression in mice. Bioconjugate Chemistry 10(6):1075-1083 (1999).
Scott et al.: Characterization and prediction of protein nucleolar localization sequences. Nucleic Acids Res, 38(21):7388-7399 (2010).
Shaw, Paul A. et al. Comparison of protein transduction domains in mediating cell delivery of a secreted CRE protein. Biochemistry 47(4):1157-1166 (2008).
Shawe-Taylor et al.: Kernel methods for pattern analysis. Cambridge University Press. 12 pages (2004).
Shen, Yimin. et al. Improved PEP-FOLD approach for peptide and miniprotein structure prediction. Journal of Chemical Theory and Computation 10(10):4745-4758 (2014).
Shoya et al.: Two proline-rich nuclear localization signals in the amino- and carboxyl-terminal regions of the Borna disease virus phosphoprotein. J .Virol, 72(12):9755-9762 (1998).
Simeoni et al.: Insight into the mechanism of the peptide-based gene delivery system MPG: implications for delivery of siRNA into mammalian cells. Nucleic Acids Research, 31(11): 27170-2724 (2003).
Somasekaram et al.: Intracellular localization of human cytidine deaminase. Identification of a functional nuclear localization signal. J Biol Chem. 274(40):28405-28412 (1999).
Stojanovski et al.: Mechanisms of protein sorting in mitochondria. Cold Spring Harbor Perspect Biol, 4(10):a011320, 18 pages (2012).
Sudbeck et al.: Two independent nuclear localization signals are present in the DNA-binding high-mobility group domains of SRY and SOX9. J Biol Chem. 272(44):27848-27852 (1997).
Summerton JE: Endo-Porter: A novel reagent for safe, effective delivery of substances into cells. Ann NY Acad Sci. 1058:62-75 (2005).
Sun et al.: PTD4-apoptin protein therapy inhibits tumor growth in vivo. Int J cancer. 124(12):2973-2981 (2009).
Sung et al.: Efficient myogenic differentiation of human adipose-derived stem cells by the transduction of engineered MyoD protein. Biochem Biophys Res Commun. 437(1):156-161 (2013).
Takahashi, Kazutoshi, and Shinya Yamanaka. Induction of Pluripotent Stem Cells From Mouse Embryonic and Adult Fibroblast Cultures by Defined Factors. Cell 126(4):663-676 (2006).
Takeda et al.: NUP98-HOXA9 induces long-term proliferation and blocks differentiation of primary human CD34+ hematopoietic cells. Cancer Res. 66(13):6628-6637 (2006).
Tan et al.: Increased levels of FoxA1 transcription factor in pluripotent P19 embryonal carcinoma cells stimulate neural differentiation. Stem Cells Dev. 19(9):1365-1374 (2010).
Tan, Ying-Xia. et al. Truncated peptides from melittin and its analog with high lytic activity at endosomal pH enhance branched polyethylenimine-mediated gene transfection. The Journal of Gene Medicine 14(4):241-250 (2012).
Tansi et al.: Internalization of near-infrared fluorescently labeled activatable cell-penetrating peptide and of proteins into human fibrosarcoma cell line HT-1080. Journal of Cellular Biochemistry. (2015) doi: 10.1002/jcb.25075.
Theriault, Olivier. et al. Differential modulation of Nav1. 7 and Nav1. 8 channels by antidepressant drugs. European Journal of Pharmacology 764:395-403 (2015).
Thevenet, Pierre. et al. PEP-FOLD: an updated de novo structure prediction server for both linear and disulfide bonded cyclic peptides. Nucleic Acids Research 40(W1):W288-W293 (2012).
Turecek, Peter L. et al. PEGylation of Biopharmaceuticals: A Review of Chemistry and Nonclinical Safety Information of Approved Drugs. Journal of Pharmaceutical Sciences 105(2):460-475 (2016).
Uherek, Christoph. et al. A modular DNA carrier protein based on the structure of diphtheria toxin mediates target cell-specific gene delivery. Journal of Biological Chemistry 273(15):8835-8841 (1998).
Ul Ain et al., Effects of protein transduction domain (PTD) selection and position for improved intracellular delivery of PTD-Hsp27 fusion protein formulations. Arch Pharm Res. 39(9):1266-1274 (2016).
U.S. Appl. No. 15/094,365 Applicant Initiated Interview Summary dated Jan. 11, 2017.
U.S. Appl. No. 15/094,365 Office Action dated Dec. 15, 2016.
U.S. Appl. No. 15/094,365 Restriction Requirement dated Aug. 2, 2016.
U.S. Appl. No. 15/486,155 Final Office Action dated Feb. 4, 2019.
U.S. Appl. No. 15/486,155 Final Office Action dated Sep. 25, 2019.
U.S. Appl. No. 15/486,155 Office Action dated Apr. 2, 2018.
U.S. Appl. No. 15/486,155 Office Action dated May 24, 2019.
U.S. Appl. No. 15/666,139 First Action Interview Office Action dated Feb. 2, 2018.
U.S. Appl. No. 16/341,681 Office Action dated Dec. 3, 2021.
U.S. Appl. No. 16/341,681 Final Office Action dated Jun. 15, 2022.
U.S. Appl. No. 16/341,681 Restriction Requirement dated Jun. 3, 2021.
U.S. Appl. No. 16/797,867 Office Action dated Nov. 3, 2023.
U.S. Appl. No. 17/604,328 Office Action dated Sep. 27, 2024.
Varkouhi, Amir K. et al. Endosomal escape pathways for delivery of Biologicals. Journal of Controlled Release 151(3):220-228 (2011). Published Online Nov. 13, 2010.
Veach, Ruth Ann. et al. Receptor/transporter-independent targeting of functional peptides across the plasma membrane. Journal of Biological Chemistry 279(12):11425-11431 (2004). Published Online Dec. 29, 2003.
Veronese, Francesco M, and Anna Mero. The Impact Of PEGylation On Biological Therapies. BioDrugs 22(5):315-329 (2008).
Vives, Eric. et al. A Truncated HIV-1 Tat Protein Basic Domain Rapidly Translocates through the Plasma Membrane and Accumulates in the Cell Nucleus. Journal of Biological Chemistry 272(25):16010-16017 (1997).
Wagstaff et al.: Histone-mediated transduction as an efficient means for gene delivery. Mol Ther. 15(4):721-731 (2007).
Wan: An Overall Comparison of Small Molecules and Large Biologics in ADME Testing. ADMET & DMPK 4(1):1-22; doi: 10.5599/admet.4.1.276 (2016).
Warr et al.: FOXO3A directs a protective autophagy program in haematopoietic stem cells. Nature 494(7437):323-327 (2013).
Welch et al.: RanBP3 contains an unusual nuclear localization signal that is imported preferentially by importin-alpha3. Mol Cell Biol. 19(12):8400-8411 (1999).
Wiedenheft et al.: RNA-guided complex from a bacterial immune system enhances target recognition through seed sequence interactions. PNAS USA 108:10092-10097 (2011).
Witzel et al.: Androgen receptor expression is a predictive marker in chemotherapy-treated patients with endocrine receptor-positive primary breast cancers. J Cancer Res Clin Oncol., 139(5):809-816 (2013).
Wu et al.: Rescuing lymphocytes from HLA-G immunosuppressive effects mediated by the tumor microenvironment. Oncotarget 6(35):37385-97 (2015).
Wu et al.: The quaking I-5 protein (QKI-5) has a novel nuclear localization signal and shuttles between the nucleus and the cytoplasm. J Biol Chem. 274(41):29202-29210 (1999).
Wyman, Tara B. et al. Design, synthesis, and characterization of a cationic peptide that binds to nucleic acids and permeabilizes bilayers. Biochemistry 36(10):3008-3017 (1997).
Ye et al.: Human leukocyte antigen G expression: as a significant prognostic indicator for patients with colorectal cancer. Mod Pathol 20:375-383 (2007).
Yie et al.: Expression of HLA-G is associated with prognosis in esophageal squamous cell carcinoma. Am J Clin Pathol 128:1002-1009 (2007).
Yie et al.: Expression of human leucocyte antigen G (HLA-G) is associated with prognosis in non-small cell lung cancer. Lung Cancer 58:267-274 (2007).
Yie et al.: Expression of human leukocyte antigen G (HLA-G) correlates with poor prognosis in gastric carcinoma. Ann Surg Oncol 14:2721-2729 (2007).

(56) References Cited

OTHER PUBLICATIONS

Yu et al.: A constitutive nuclear localization signal from the second zinc-finger of orphan nuclear receptor TR2. J Endocrinol. 159(1):53-60 (1998).
Yuan et al., Development of siRNA payloads to target KRAS-mutant cancer. Cancer Discov. 4(10): 1182-1197 (2014).
Zahid et al., Cell-type specific penetrating peptides: therapeutic promises and challenges. Molecules. 20;20(7):13055-13070 (2015).
Zetsche et al.: Cpf1 Is a Single RNA-Guided Endonuclease of a Class 2 CRISPR-Cas System. Cell. 25. pii: S0092-8674(15)01200-3[ http://dx.doi.org/10.1016/j.cell.2015.09.038] (2015).
Zhen et al.: Impact of HLA-E gene polymorphism on HLA-E expression in tumor cells and prognosis in patients with stage III colorectal cancer. Med Oncol 30:482 (2013).
Zhou, Hongyan. et al. Generation of induced pluripotent stem cells using recombinant proteins. Cell Stem Cell 4(5):381-384 (2009).

\* cited by examiner

Fig. 20
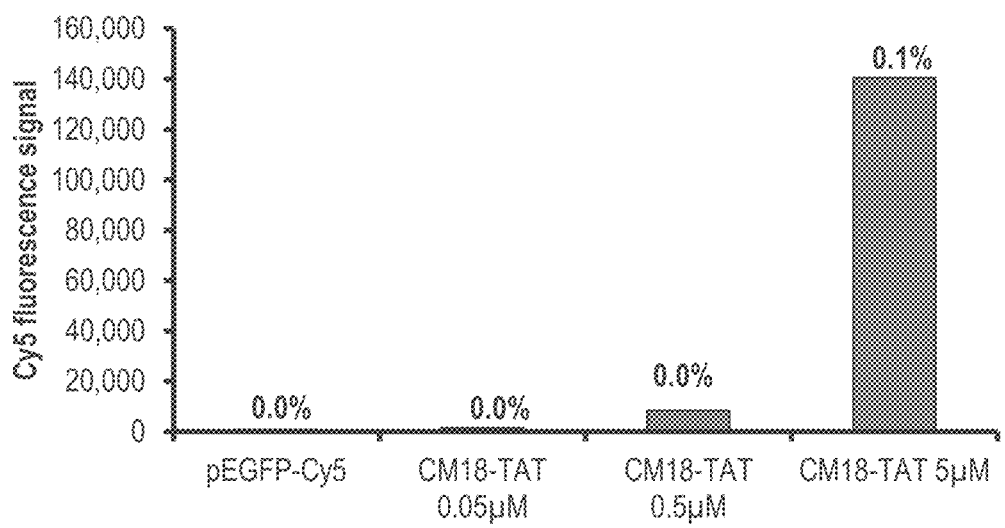
Fig. 21A
Fig. 21B
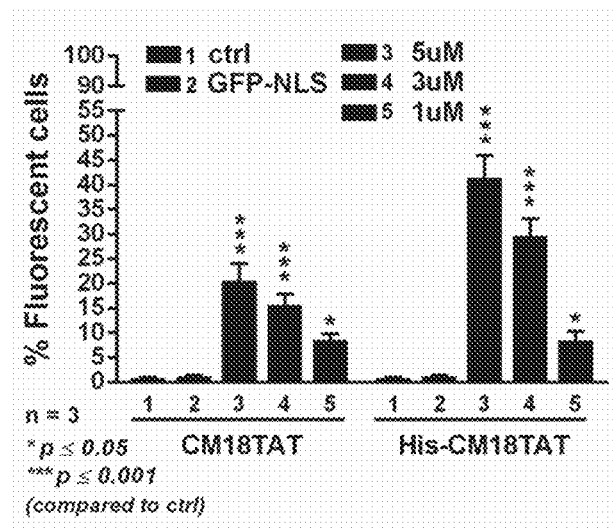
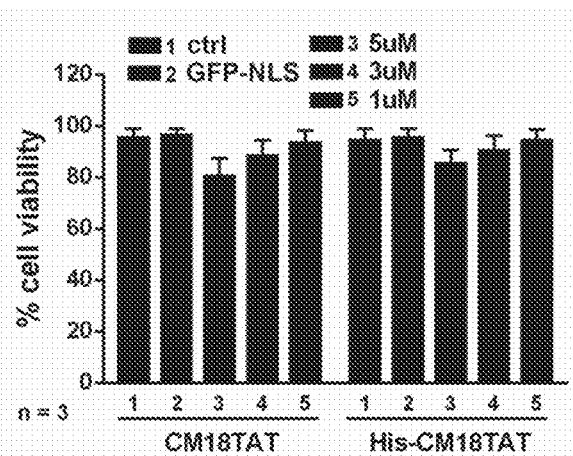

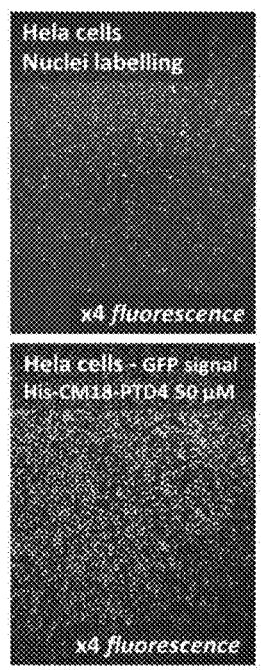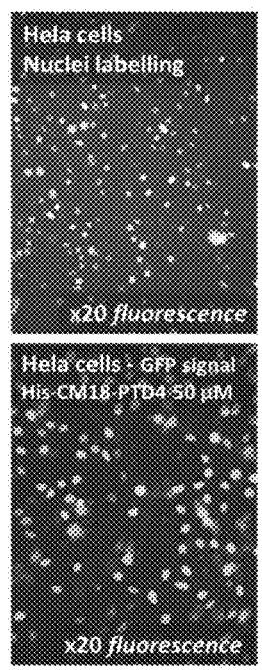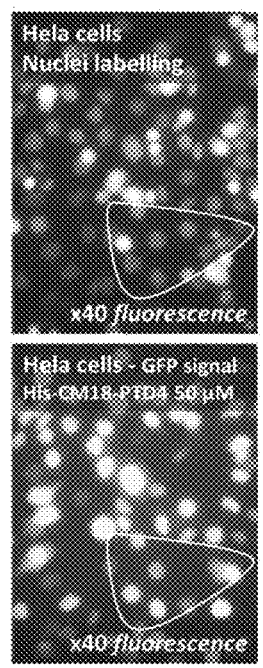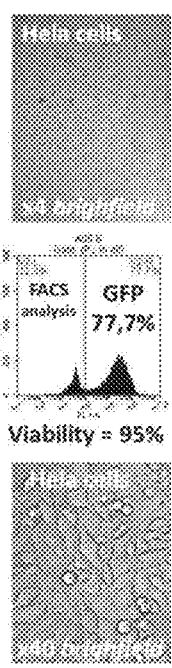
Fig. 23A  Fig. 23B  Fig. 23C  Fig. 23D
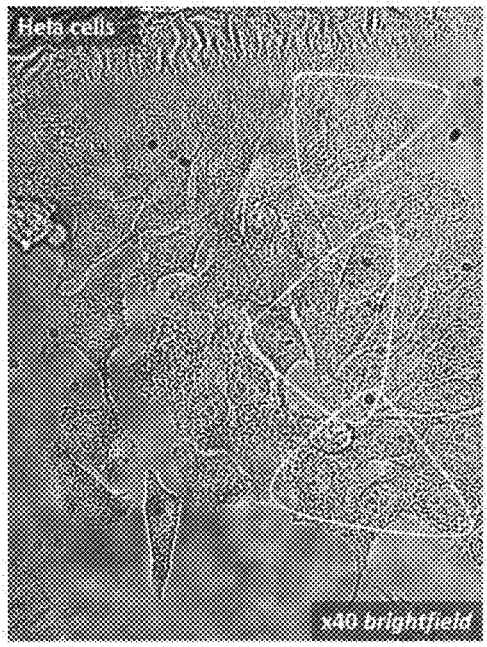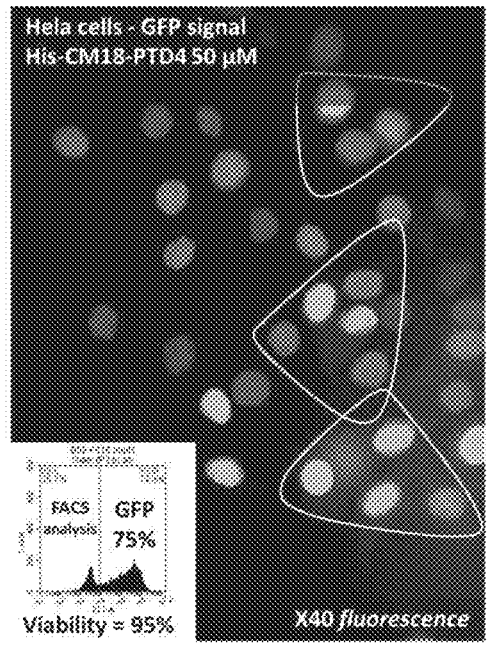
Fig. 24A  Fig. 24B Fig. 25A
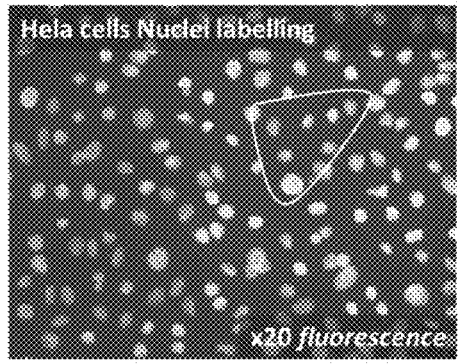
Fig. 25B
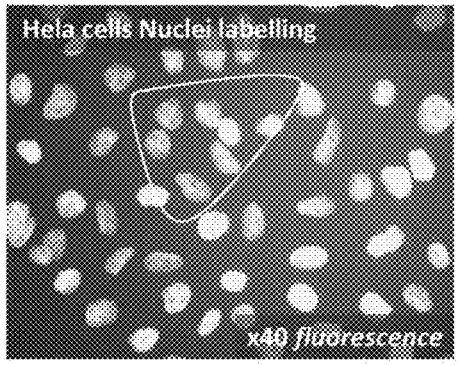
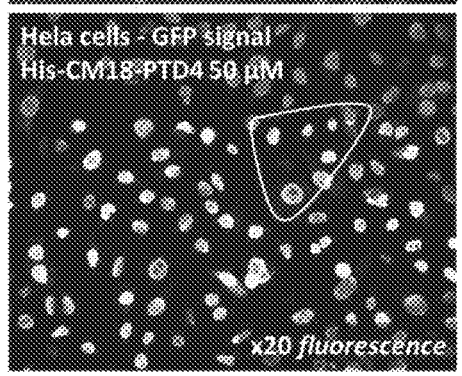
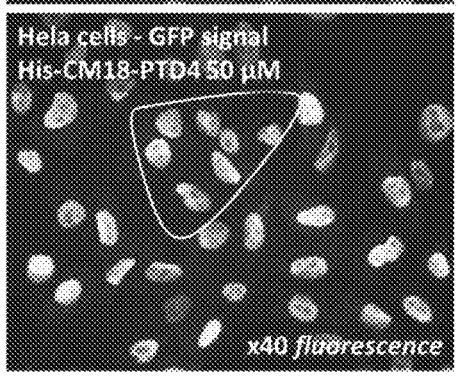
Fig. 26A
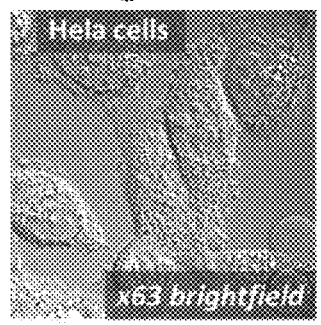
Fig. 26C
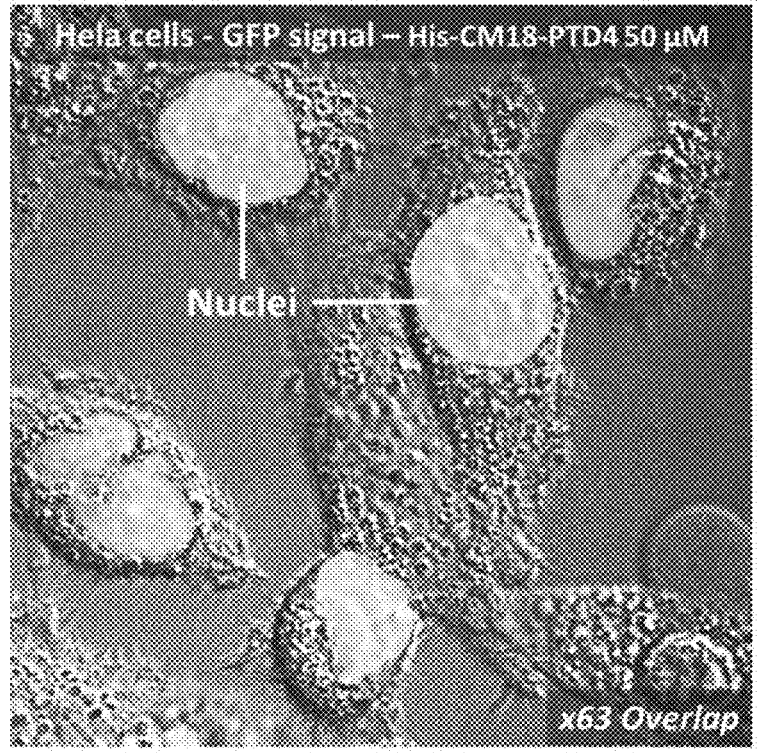
Fig. 26B
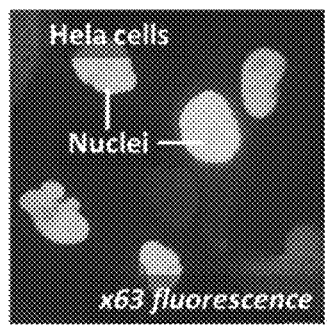

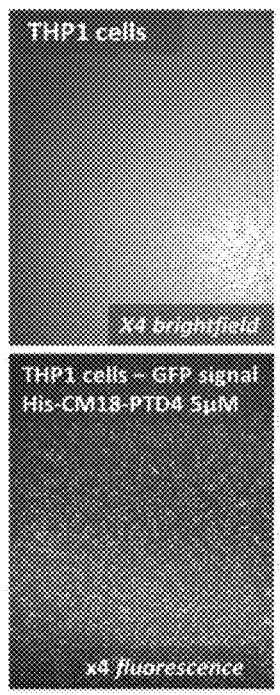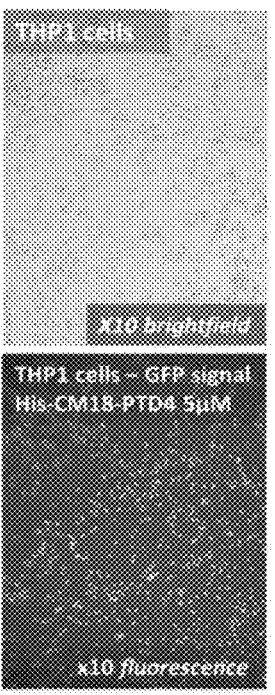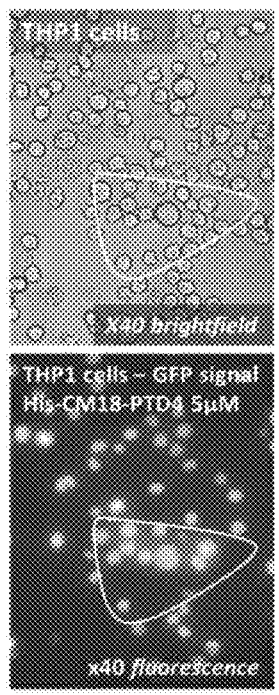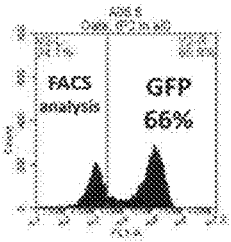
Fig. 32A   Fig. 32B   Fig. 32C   Fig. 32D
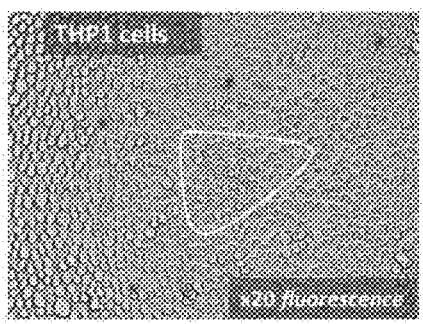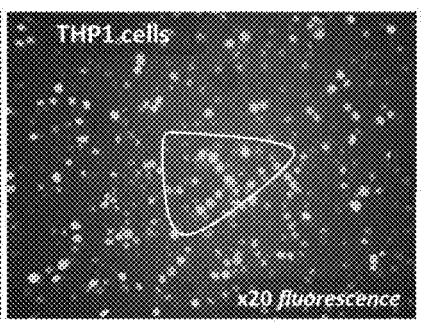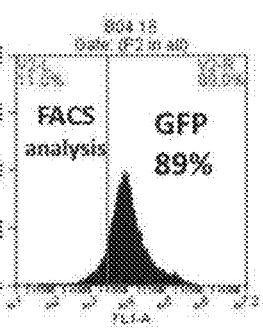
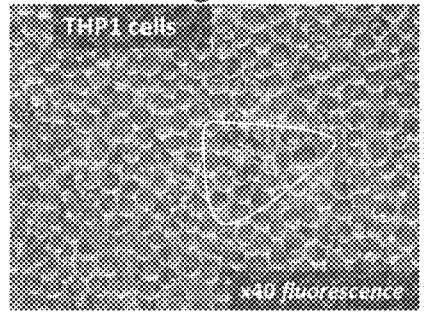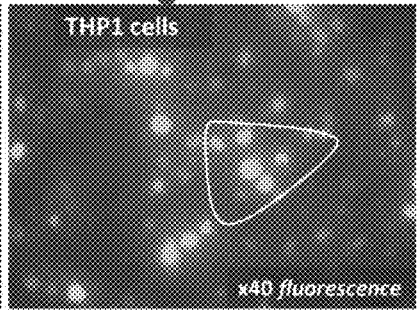
Fig. 33A   Fig. 33C
Fig. 33B   Fig. 33D

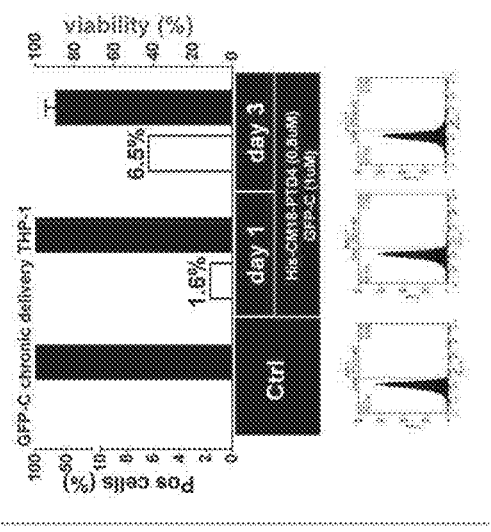
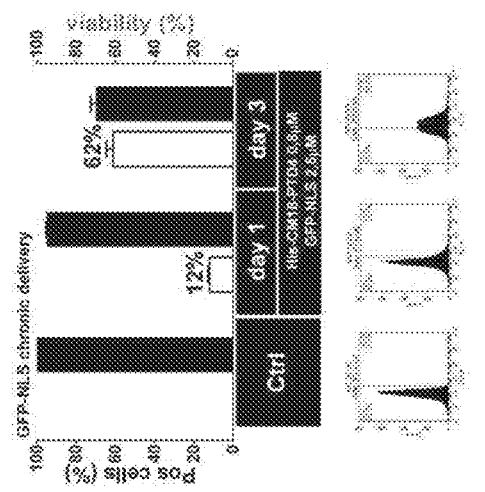
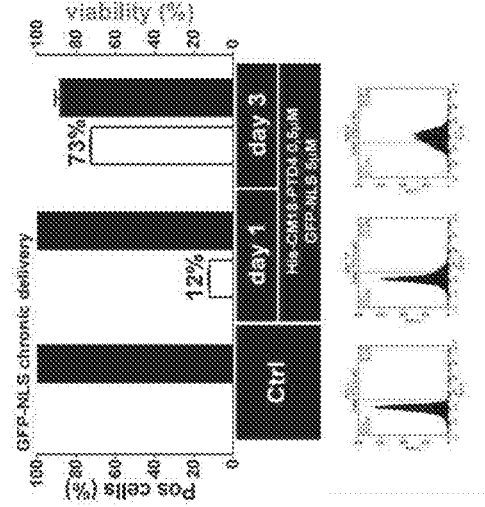
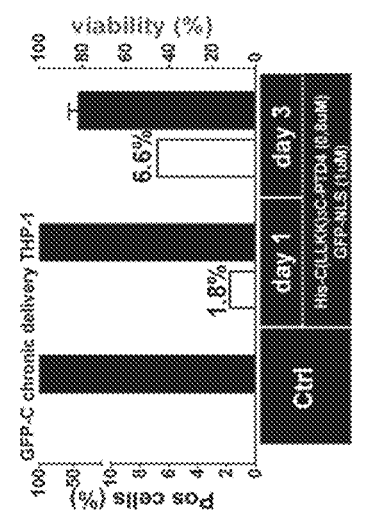
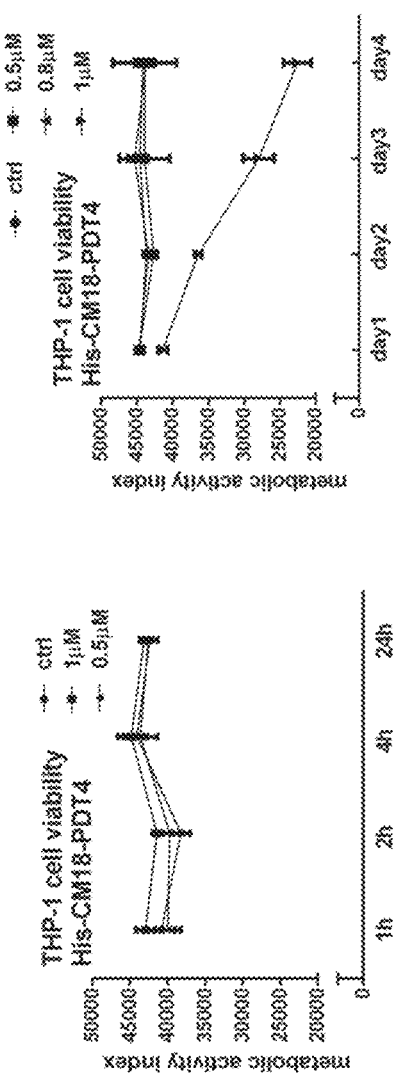
Fig. 35A  Fig. 35B  Fig. 35C  Fig. 35D  Fig. 35E  Fig. 35F

 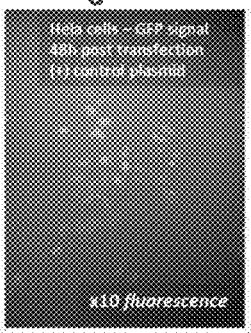  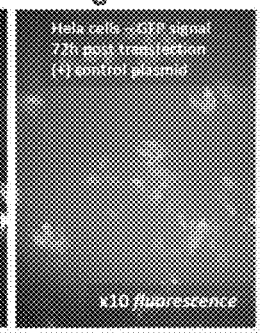
 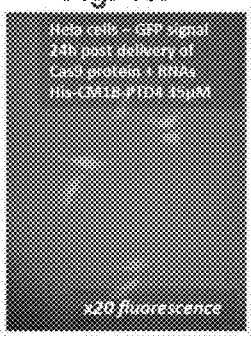 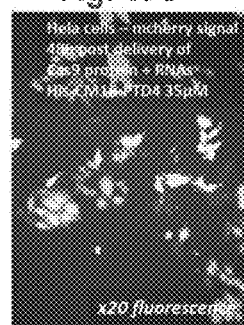 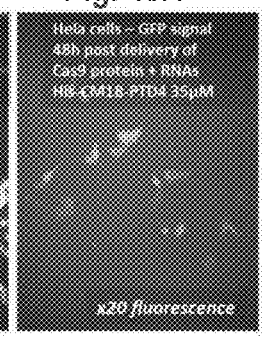
Fig. 40A  Fig. 40B  Fig. 40C  Fig. 40D
Fig. 40E  Fig. 40F  Fig. 40G  Fig. 40H
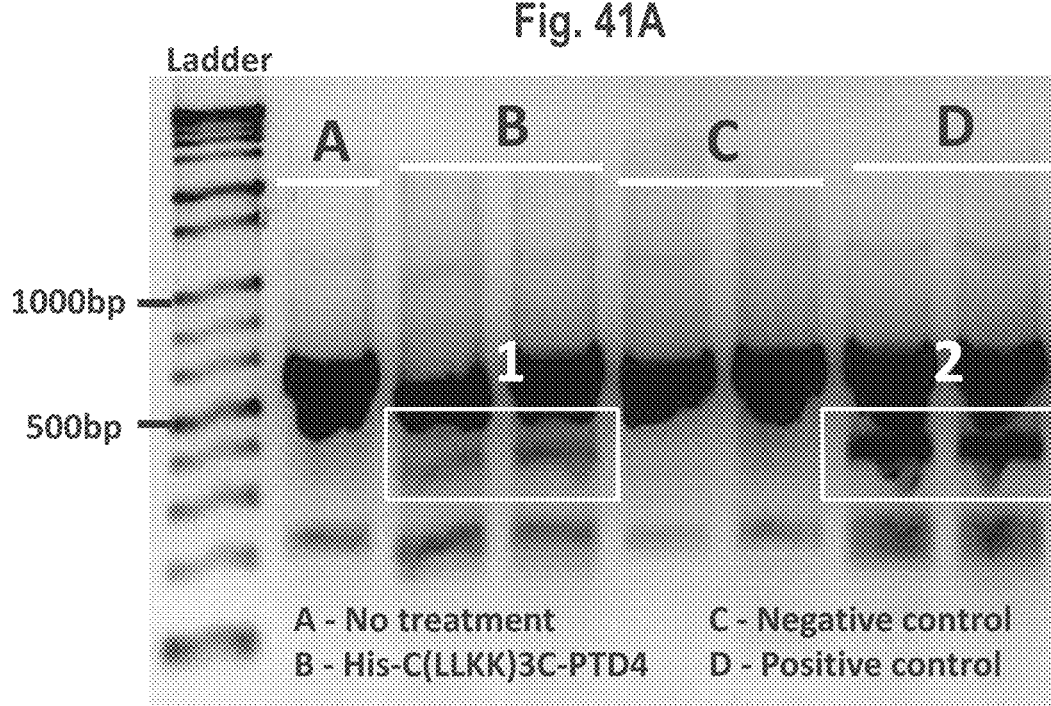
Fig. 41A Fig. 44
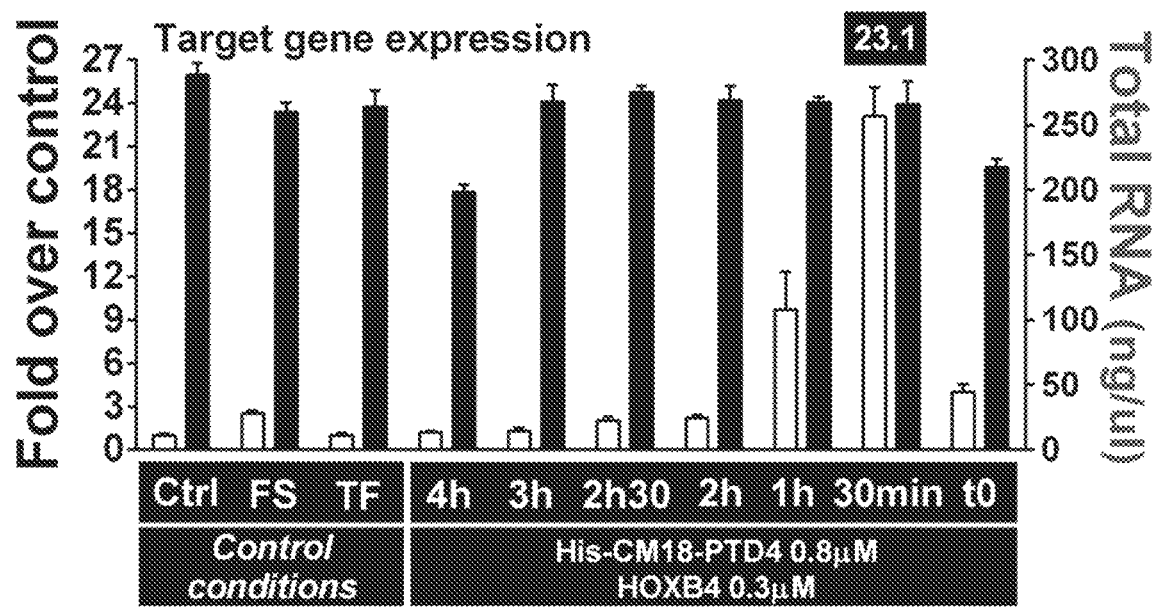
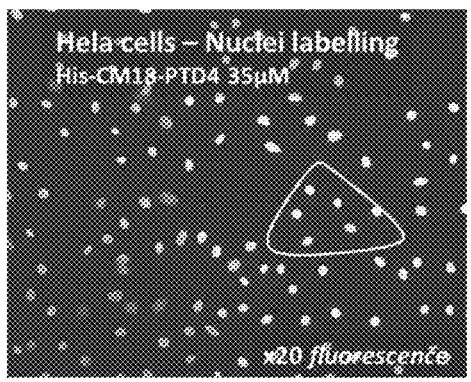
Fig. 45A
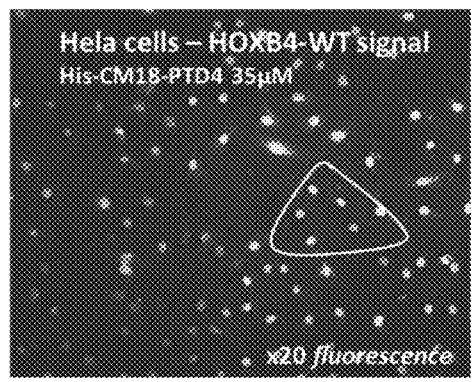
Fig. 45B
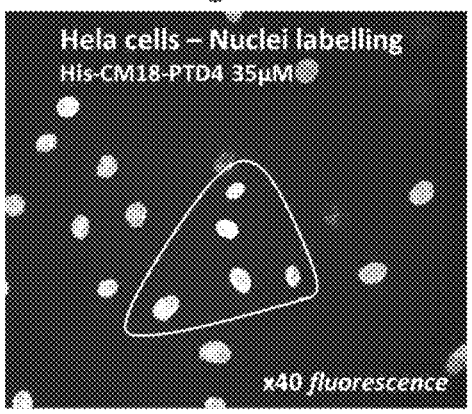
Fig. 45C
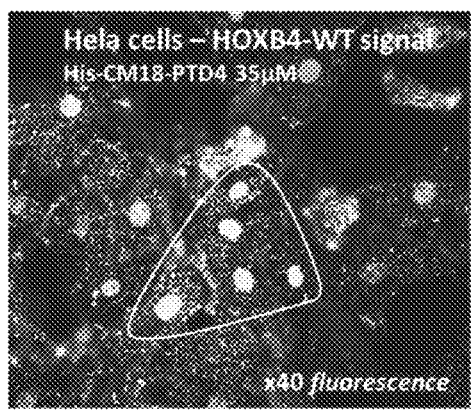
Fig. 45D

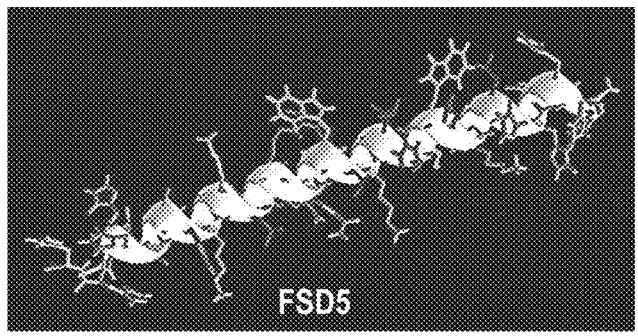
Fig. 49C FSD5
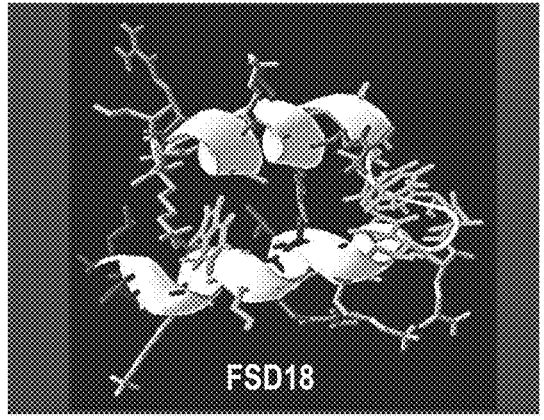
Fig. 49D FSD18
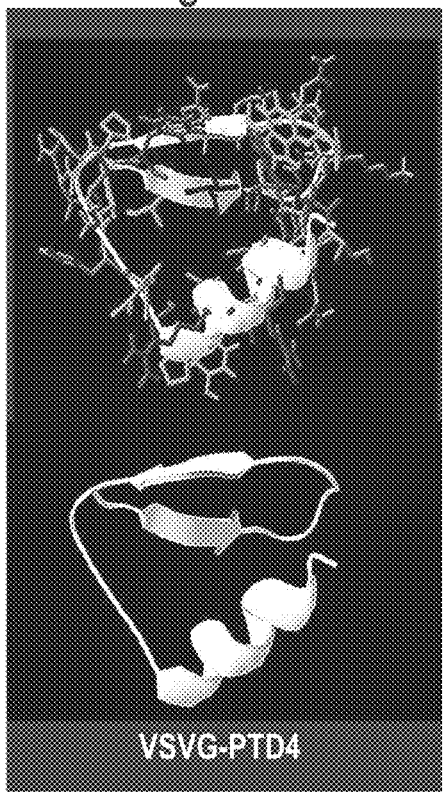
Fig. 49E VSVG-PTD4
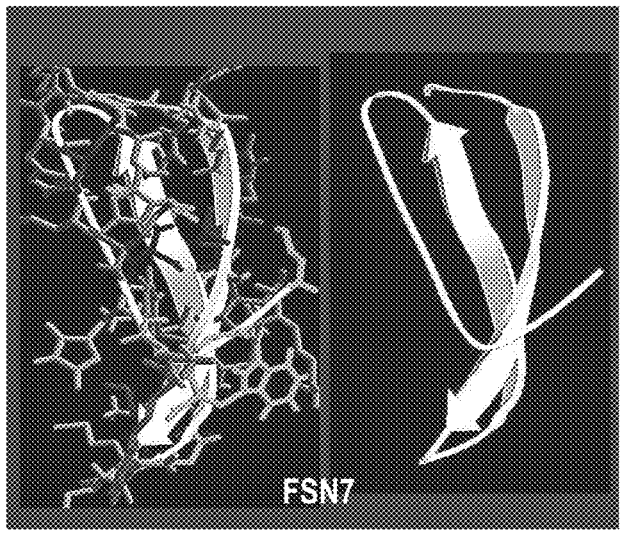
Fig. 49F FSN7

Fig. 49G

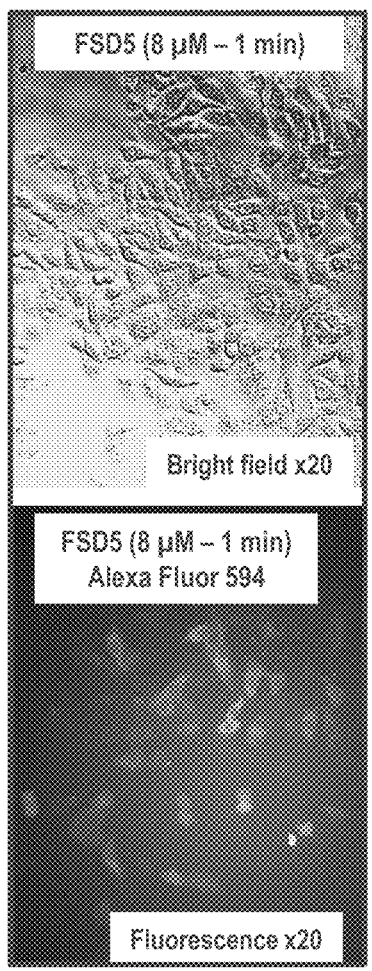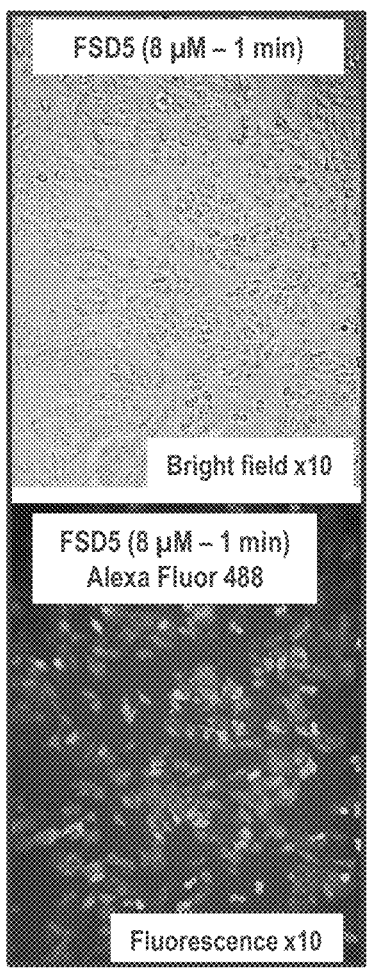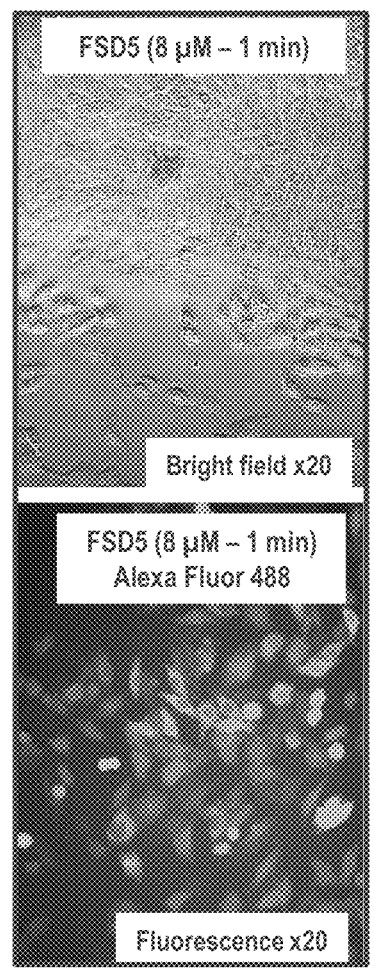

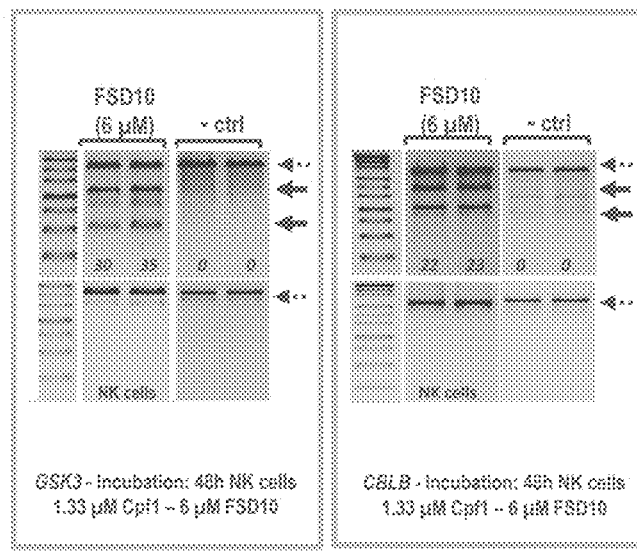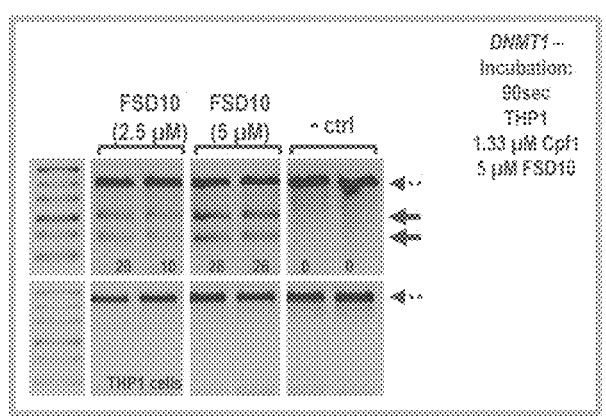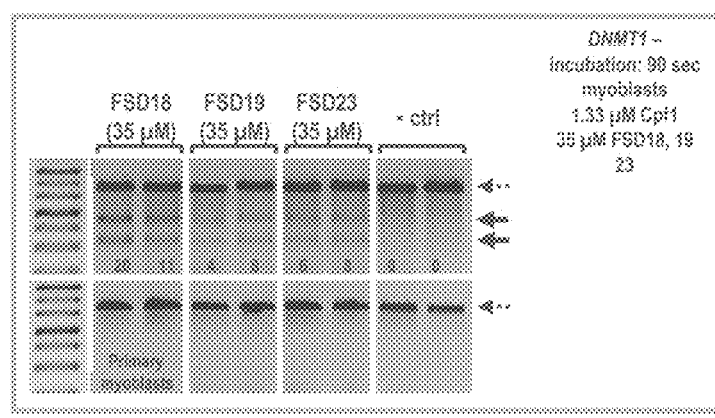

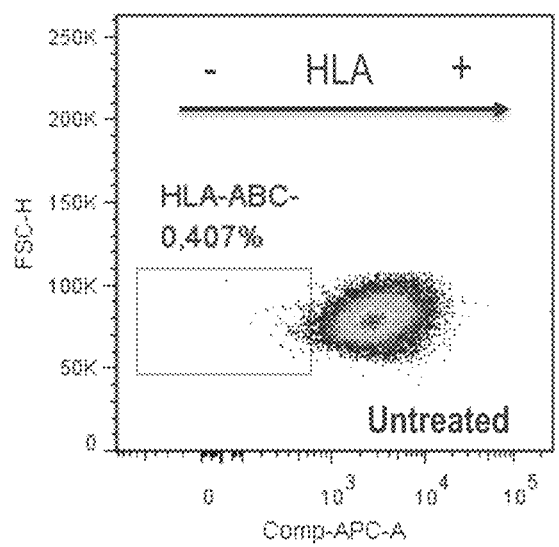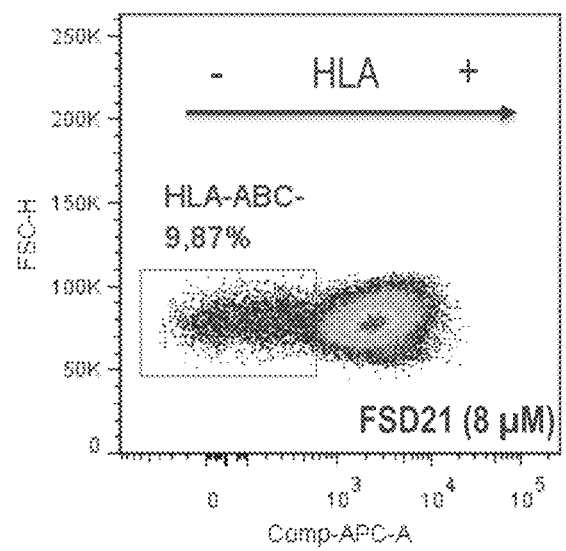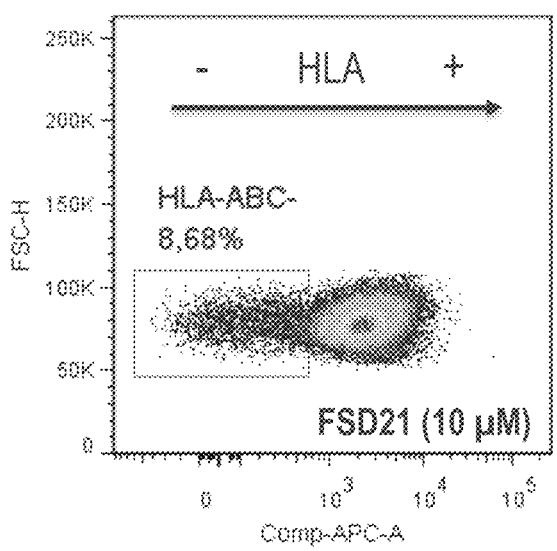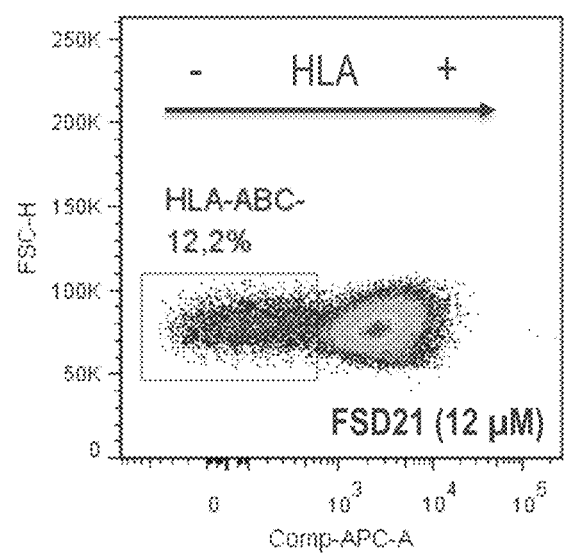

Untreated crRNA E crRNA G crRNA J crRNA E + G + J

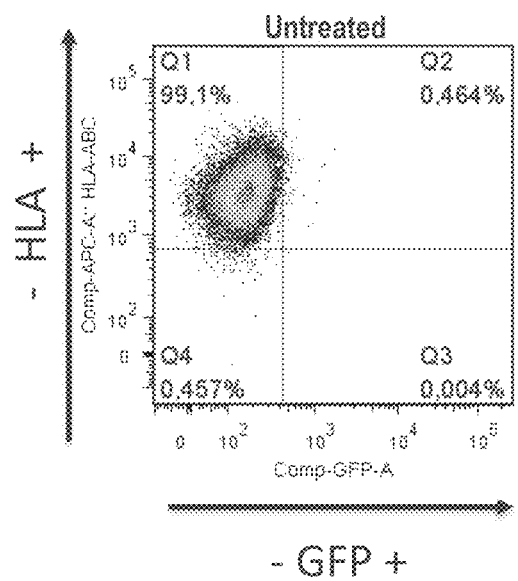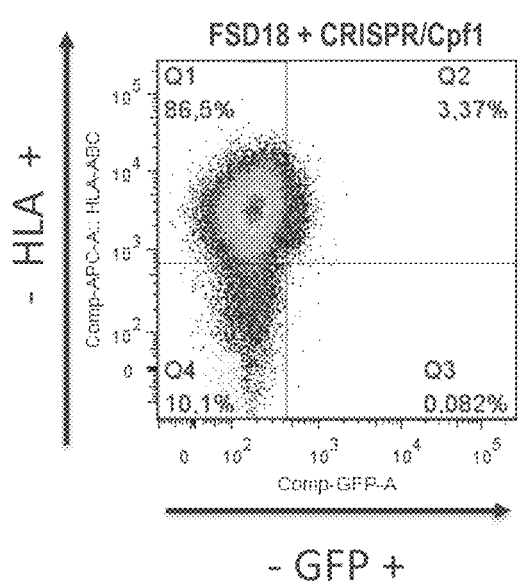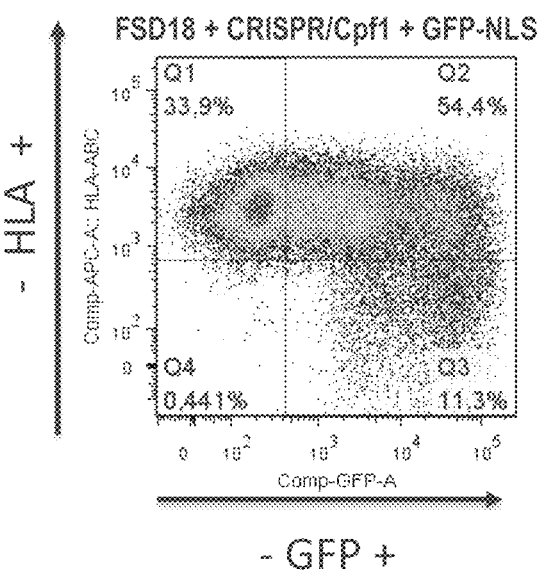

FACS sorting for GFP-negative cells

FACS sorting for GFP-positive cells

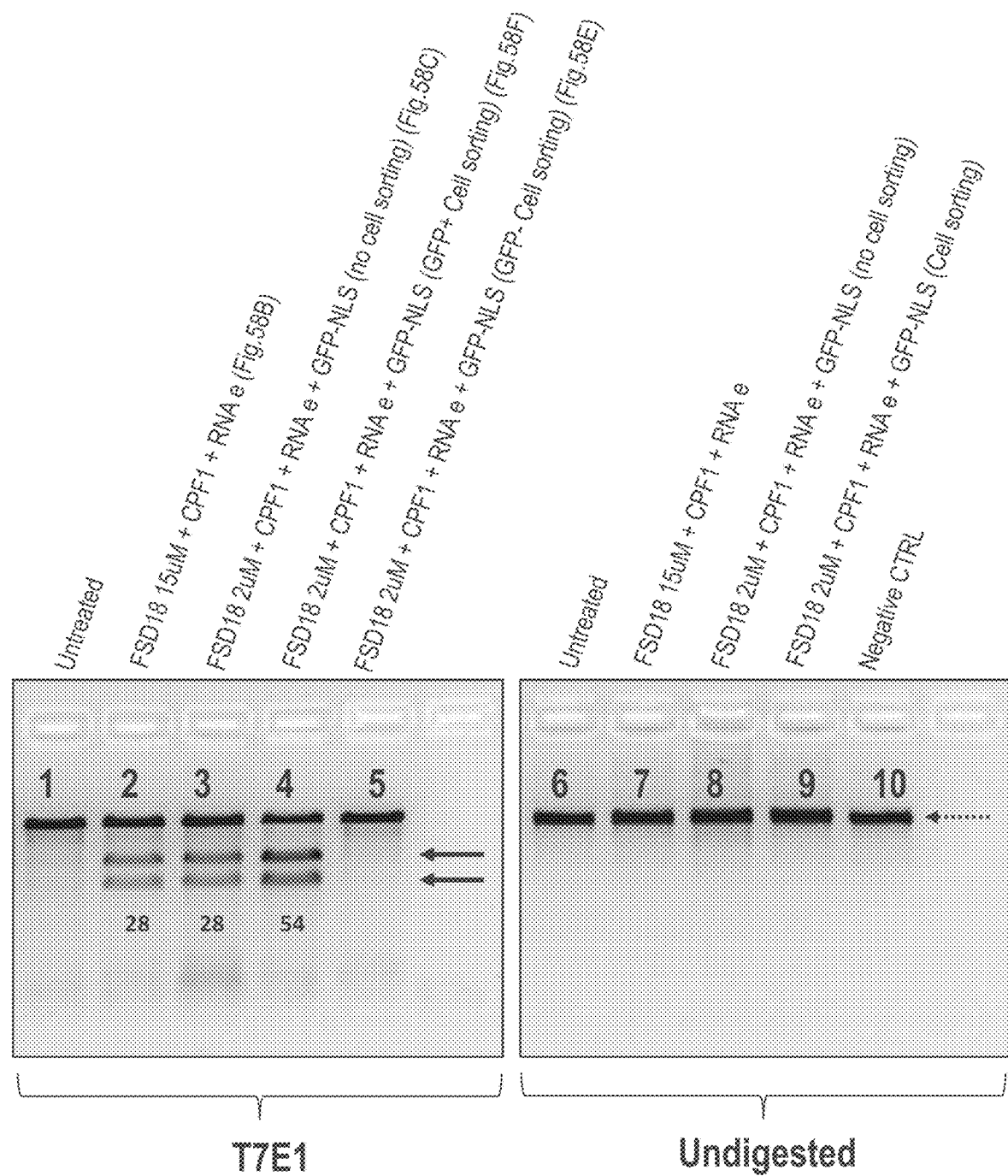

Untreated

Untreated

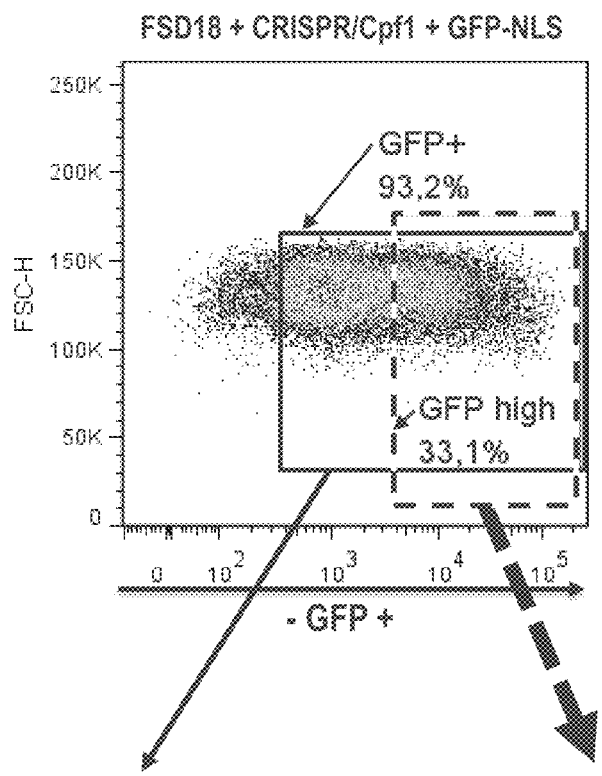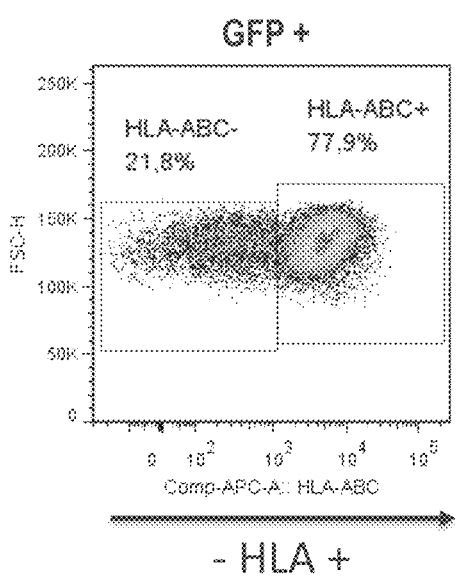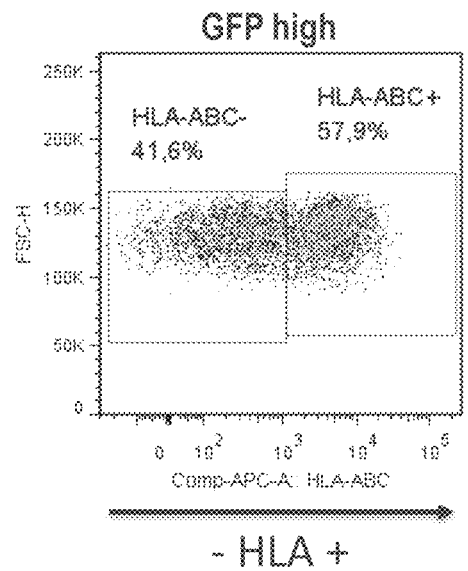

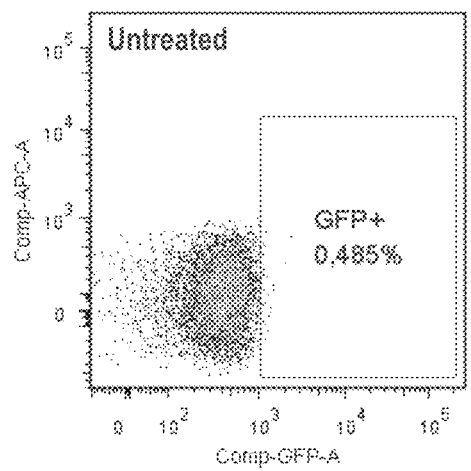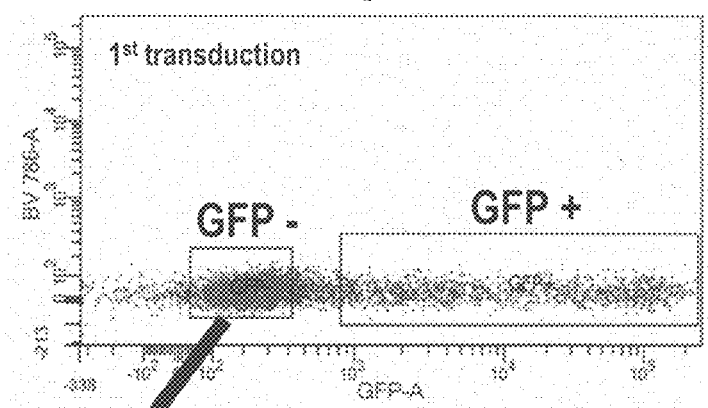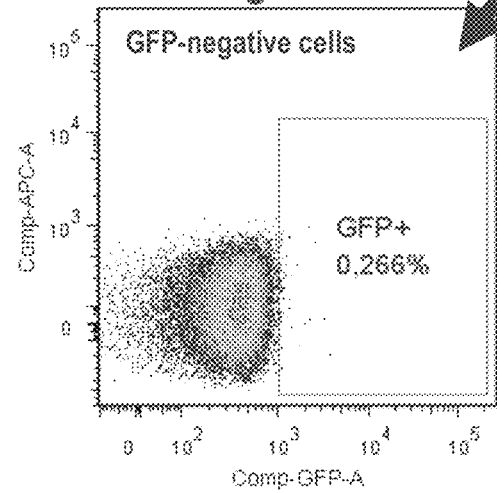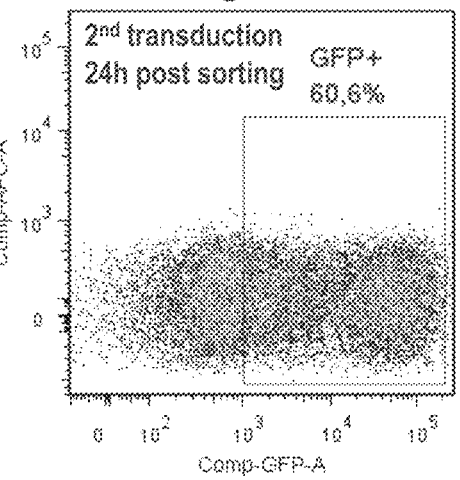

RATIONALLY-DESIGNED SYNTHETIC PEPTIDE SHUTTLE AGENTS FOR DELIVERING POLYPEPTIDE CARGOS FROM AN EXTRACELLULAR SPACE TO THE CYTOSOL AND/OR NUCLEUS OF A TARGET EUKARYOTIC CELL, USES THEREOF, METHODS AND KITS RELATING TO SAME

CROSS-REFERENCE

This application is a continuation of U.S. application Ser. No. 16/341,681, filed on Apr. 12, 2019, pursuant to 35 U.S.C. § 371 as a United States National Phase Application of International Application No. PCT/CA2017/051205 filed on Oct. 11, 2017, which is a Continuation of U.S. application Ser. No. 15/666,139 filed Aug. 1, 2017, now U.S. Pat. No. 9,982,267, issued May 29, 2018, which claims benefit of U.S. Provisional Patent Application No. 62/535,015 filed on Jul. 20, 2017, and U.S. Provisional Patent Application No. 62/407,232 filed on Oct. 12, 2016 all of which are incorporated herein by reference in their entirety.

The present description relates to synthetic peptide shuttle agents useful for delivering a variety of polypeptide cargos from an extracellular space to the cytosol and/or nucleus of target eukaryotic cells. More specifically, the present description relates to parameters useful in the rational design of such synthetic peptide shuttle agents.

BACKGROUND

Cell delivery technologies to transport large molecules inside eukaryotic cells have a wide range of applications, particularly in the biopharmaceutical industry. While some soluble chemical substances (e.g., small molecule drugs) may passively diffuse through the eukaryotic cell membrane, larger cargos (e.g., biologics, polynucleotides, and polypeptides) require the help of shuttle agents to reach their intracellular targets.

Areas that would greatly benefit from advances in cell delivery technologies include the fields of genome editing and cell therapy, which have made enormous leaps over the last two decades. Deciphering the different growth factors and molecular cues that govern cell expansion, differentiation and reprogramming open the door to many therapeutic possibilities for the treatment of unmet medical needs. For example, induction of pluripotent stem cells directly from adult cells, direct cell conversion (trans-differentiation), and genome editing (Zinc finger nuclease, TALEN and CRISPR-associated endonuclease technologies) are examples of methods that have been developed to maximize the therapeutic value of cells for clinical applications. Presently, the production of cells with high therapeutic activity usually requires ex vivo manipulations, mainly achieved by viral transduction, raising important safety and economical concerns for human applications. The ability to directly deliver active proteins such as transcription factors or artificial nucleases, inside these cells, may advantageously circumvent the safety concerns and regulatory hurdles associated with more risky gene transfer methods. In particular, methods of directly delivering active genome editing complexes in immune cells in order to improve immunotherapy would be highly desirable.

Protein transduction approaches involving fusing a recombinant protein cargo directly to a cell-penetrating peptide (e.g., HIV transactivating protein TAT) require large amounts of the recombinant protein and often fail to deliver the cargo to the proper subcellular location, leading to massive endosomal trapping and eventual degradation. Several endosomal membrane-disrupting peptides have been developed to try to facilitate the escape of endosomally-trapped cargos to the cytosol. However, many of these endosomolytic peptides have been used to alleviate endosomal entrapment of cargos that have already been delivered intracellularly, and do not by themselves aid in the initial step of shuttling the cargos intracellularly across the plasma membrane (Salomone et al., 2012; Salomone et al., 2013; Erazo-Oliveras et al., 2014; Fasoli et al., 2014).

In particular, Salomone et al., 2012 described a chimeric peptide $CM_{18}$-$TAT_{11}$, resulting from the fusion of the $Tat_{11}$ cell penetrating motif to the CM18 hybrid (residues 1-7 of Cecropin-A and 2-12 of Melittin). This peptide was reported to be rapidly internalized by cells (due to its TAT motif) and subsequently responsible for destabilizing the membranes of endocytic vesicles (due to the membrane disruptive abilities of the CM18 peptide). Although the peptide $CM_{18}$-$TAT_{11}$ fused to the fluorescent label Atto-633 (molecular weight of 774 Da; 21% of the MW of the peptide) was reported to facilitate the escape of endosomally trapped $TAT_{11}$-EGFP to the cytosol (see FIG. 3 of Salomone et al., 2012), the $CM_{18}$-$TAT_{11}$ peptide (alone or conjugated to Atto-633) was not shown to act as a shuttle agent that can increase delivery of a polypeptide cargo from an extracel/ular space to inside of the cell—i.e., across the plasma membrane. In fact, Salomone et al., 2012 compared co-treatment (simultaneous treatment of $TAT_{11}$-EGFP and $CM_{18}$-$TAT_{11}$-Atto-633) versus time-shifted treatment (i.e., incubation of cells with $TAT_{11}$-EGFP alone, fluorescence imaging, and then incubation of the same cells with the $CM_{18}$-$TAT_{11}$-Atto-633 peptide alone, and again fluorescence imaging), and the authors reported that "both yielded the same delivery results" (see page 295 of Salomone et al., 2012, last sentence of first paragraph under the heading "2.9 Cargo delivery assays"). In other words, Salomone et al., 2012 described that the peptide $CM_{18}$-$TAT_{11}$ (alone or conjugated to Atto-633) had no effect on delivery of a polypeptide cargo from an extracellular space to inside of the cell (i.e., protein transduction). Thus, there remains a need for improved shuttle agents capable of increasing the transduction efficiency of polypeptide cargos, and delivering the cargos to the cytosol and/or nucleus of target eukaryotic cells.

The present description refers to a number of documents, the content of which is herein incorporated by reference in their entirety.

SUMMARY

A plurality of different peptides was screened with the goal of identifying polypeptide-based shuttle agents that can deliver independent polypeptide cargos intracellularly to the cytosol/nucleus of eukaryotic cells. On one hand, these large-scale screening efforts led to the surprising discovery that certain domain-based peptide shuttle agents increase the transduction efficiency of polypeptide cargos in eukaryotic cells, by increasing the number and/or proportion of cells that ultimately internalize the polypeptide cargos, and also enable the internalized cargos to gain access to the cytosol/nuclear compartment (thus avoiding or reducing cargo endosomal entrapment). These domain-base shuttle agents comprise an endosome leakage domain (ELD) operably linked to a cell penetrating domain (CPD), and optionally one or more histidine-rich domains. On the other hand, the above screening efforts also revealed some peptides having no or low polypeptide cargo transduction activity, excessive toxicity, and/or other undesirable properties (e.g., poor solubility and/or stability). These empirical data (both positive and negative) were used herein to identify physiochemical properties of successful, less successful, and failed peptides in order to arrive at a set of design parameters that enable the rational design and/or identification of peptides having protein transduction activity.

Accordingly, the present description relates to methods for delivering polypeptide cargos from an extracellular space to the cytosol and/or nucleus of a target eukaryotic cell by contacting the cell with the polypeptide cargo in the presence of a peptide shuttle agent as described herein, at a concentration sufficient to increase the polypeptide cargo's transduction efficiency, as compared to in the absence of the shuttle agent. More particularly, the present description relates to parameters that may be used in the rational design of such synthetic peptide shuttle agents, peptide shuttle agents that satisfy one or more of these design parameters, as well as methods and compositions relating to the use of the synthetic peptide shuttle agents for delivery of a variety of polypeptide cargos from an extracellular space to the cytosol and/or nucleus of target eukaryotic cells. The present description also relates to machine-learning or computer-assisted approaches that may be used to generate peptide variants that respect one or more of the design parameters described herein.

The present description also relates to co-transducing a polypeptide cargo of interest and a marker protein as a means to identify and/or enrich transduced cells. It was surprisingly discovered that a strikingly high proportion of target eukaryotic cells that were successfully transduced with a polypeptide cargo of interest, were also successfully transduced with a marker protein. Conversely, a strikingly high proportion of cells that were not transduced with the polypeptide cargo of interest, were also not transduced with the marker protein. Isolating cells positive for the marker protein (e.g., via FACS) resulted in a significant increase in the proportion of cells that were successfully transduced with the polypeptide cargo of interest, and the correlation was found to be concentration dependent in that cell populations exhibiting the highest fluorescence of the marker protein also tended to exhibit the highest proportion of transduction with the polypeptide cargo of interest. It was also discovered that cells that were unsuccessfully transduced following a first round of transduction with a polypeptide cargo of interest, may be isolated and re-transduced with the polypeptide cargo of interest in subsequent rounds of transduction. Thus, in some aspects, the present description relates to methods comprising co-transduction of a polypeptide cargo of interest with a marker protein, wherein the marker protein may be used to isolate or enrich cells transduced with a polypeptide cargo of interest. In some embodiments, the present description also relates to methods comprising repeated successive transduction experiments performed on, for example, cells that were not successfully transduced with a marker protein following a first or previous transduction reaction. Such methods present attractive approaches for increasing transduction efficiency in valuable cell populations (e.g., patient-derived cells for cell therapy), and/or in cell populations that are inherently more difficult to transduce.

General Definitions

Headings, and other identifiers, e.g., (a), (b), (i), (ii), etc., are presented merely for ease of reading the specification and claims. The use of headings or other identifiers in the specification or claims does not necessarily require the steps or elements be performed in alphabetical or numerical order or the order in which they are presented.

The use of the word "a" or "an" when used in conjunction with the term "comprising" in the claims and/or the specification may mean "one" but it is also consistent with the meaning of "one or more", "at least one", and "one or more than one". The term "about" is used to indicate that a value includes the standard deviation of error for the device or method being employed in order to determine the value. In general, the terminology "about" is meant to designate a possible variation of up to 10%. Therefore, a variation of 1, 2, 3, 4, 5, 6, 7, 8, 9 and 10% of a value is included in the term "about". Unless indicated otherwise, use of the term "about" before a range applies to both ends of the range.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

As used herein, "protein" or "polypeptide" or "peptide" means any peptide-linked chain of amino acids, which may or may not comprise any type of modification (e.g., chemical or post-translational modifications such as acetylation, phosphorylation, glycosylation, sulfatation, sumoylation, prenylation, ubiquitination, etc.). For further clarity, protein/polypeptide/peptide modifications are envisaged so long as the modification does not destroy the protein transduction activity of the shuttle agents described herein As used herein, a "domain" or "protein domain" generally refers to a part of a protein having a particular functionality or function. Some domains conserve their function when separated from the rest of the protein, and thus can be used in a modular fashion. The modular characteristic of many protein domains can provide flexibility in terms of their placement within the shuttle agents of the present description. However, some domains may perform better when engineered at certain positions of the shuttle agent (e.g., at the N- or C-terminal region, or therebetween). The position of the domain within its endogenous protein is sometimes an indicator of where the domain should be engineered within the shuttle agent and of what type/length of linker should be used. Standard recombinant DNA techniques can be used by the skilled person to manipulate the placement and/or number of the domains within the shuttle agents of the present description in view of the present disclosure. Furthermore, assays disclosed herein, as well as others known in the art, can be used to assess the functionality of each of the domains within the context of the shuttle agents (e.g., their ability to facilitate cell penetration across the plasma membrane, endosome escape, and/or access to the cytosol). Standard methods can also be used to assess whether the domains of the shuttle agent affect the activity of the cargo to be delivered intracellularly. In this regard, the expression "operably linked" as used herein refers to the ability of the domains to carry out their intended function(s) (e.g., cell penetration, endosome escape, and/or subcellular targeting) within the context of the shuttle agents of the present description. For greater clarity, the expression "operably linked" is meant to define a functional connection between two or more domains without being limited to a particular order or distance between same.

As used herein, the term "synthetic" used in expressions such as "synthetic peptide" or "synthetic polypeptide" is intended to refer to non-naturally occurring molecules that can be produced in vitro (e.g., synthesized chemically and/or produced using recombinant DNA technology). The purities of various synthetic preparations may be assessed by, for example, high-performance liquid chromatography analysis and mass spectroscopy. Chemical synthesis approaches may be advantageous over cellular expression systems (e.g., yeast or bacteria protein expression systems), as they may preclude the need for extensive recombinant protein purification steps (e.g., required for clinical use). In contrast, longer synthetic polypeptides may be more complicated and/or costly to produce via chemical synthesis approaches and such polypeptides may be more advantageously produced using cellular expression systems. In some embodiments, the peptides or shuttle agent of the present description may be chemically synthesized (e.g., solid- or liquid phase peptide synthesis), as opposed to expressed from a recombinant host cell. In some embodiments, the peptides or shuttle agent of the present description may lack an N-terminal methionine residue. A person of skill in the art may adapt a synthetic peptide or shuttle agent of the present description by using one or more modified amino acids (e.g., non-naturally-occurring amino acids), or by chemically modifying the synthetic peptide or shuttle agent of the present description, to suit particular needs of stability or other needs.

The expression "polypeptide-based" when used here in the context of a shuttle agent of the present description, is intended to distinguish the presently described shuttle agents from non-polypeptide or non-protein-based shuttle agents such as lipid- or cationic polymer-based transduction agents, which are often associated with increased cellular toxicity and may not be suitable for use in human therapy.

As used herein, the term "independent" is generally intended refer to molecules or agents which are not covalently bound to one another. For example, the expression "independent polypeptide cargo" is intended to refer to a polypeptide cargo to be delivered intracellularly that is not covalently bound (e.g., not fused) to a shuttle agent of the present description. In some aspects, having shuttle agents that are independent of (not fused to) a polypeptide cargo may be advantageous by providing increased shuttle agent versatility—e.g., not being required to re-engineer a new fusion protein for different polypeptide cargoes, and/or being able to readily vary the ratio of shuttle agent to cargo (as opposed to being limited to a 1:1 ratio in the case of a fusion protein).

As used herein, the expression "is or is from" or "is from" comprises functional variants of a given protein domain (e.g., CPD or ELD), such as conservative amino acid substitutions, deletions, modifications, as well as variants or function derivatives, which do not abrogate the activity of the protein domain.

Other objects, advantages and features of the present description will become more apparent upon reading of the following non-restrictive description of specific embodiments thereof, given by way of example only with reference to the accompanying drawings.

BRIEF DESCRIPTION OF THE DRAWINGS

In the appended drawings:
FIG. 1A shows the results of a fluorescence microscopy experiment, while
FIG. 1B shows the results of a flow cytometry experiment.

FIG. 20 shows the results of DNA transfection efficiency experiment in which plasmid DNA (pEGFP) was labeled with a Cy5™ dye was co-incubated with 0, 0.05, 0.5, or 5 μM of CM18-TAT-Cys (labeled "CM18-TAT"), prior to being exposed to HEK293A cells. Flow cytometry analysis allowed quantification of Cy5™ emission (corresponding to DNA intracellular delivery; y-axis) and GFP emission (corresponding to successful nuclear delivery of DNA; percentage indicated above each bar).

FIGS. 21A and 21B show the results of a GFP-NLS transduction efficiency experiment in which the GFP-NLS cargo protein (5 μM) was co-incubated with 1, 3, or 5 μM of CM18-TAT-Cys (labeled "CM18TAT"), of His-CM18-TAT (labeled "His-CM18TAT"), prior to being exposed to HeLa cells. Cells were evaluated by flow cytometry and the percentage of fluorescent (GFP-positive) cell is shown in FIG. 21A, and corresponding cell toxicity data is shown in FIG. 21B.

FIG. 22A shows a comparison of GFP-NLS transduction efficiencies using different transduction protocols (Protocol A vs. B). FIG. 22B shows the effect of using different concentrations of the shuttle His-CM18-PTD4 when using Protocol B.

FIGS. 23-26 are microscopy images showing the results of transduction experiments in which GFP-NLS (FIG. 23, 24A, 24B, 25 and 26) or FITC-labeled anti-tubulin antibody (FIGS. 24C and 24D) cargo protein was intracellularly delivered with the shuttle His-CM18-PTD4 in HeLa cells. The bright field and fluorescence images of living cells are shown in FIGS. 23, 24 and 26. In FIG. 25, the cells were fixed, permeabilized and subjected to immuno-labelling with an anti-GFP antibody and a fluorescent secondary antibody. White triangle windows indicate examples of areas of co-labelling between nuclei (DAPI) and GFP-NLS signals. FIG. 26 shows images captured by confocal microscopy.

In FIGS. 29A and 29D-29F, cells were exposed to the cargo/shuttle agent for 10 seconds. In panel I, cells were exposed to the cargo/shuttle agent for 1 minute. In FIGS. 29B, 29C, 29G and 29H, cells were exposed to the cargo/shuttle agent for 1, 2, or 5 min. "Relative fluorescence intensity (FL1-A)" or "Signal intensity" corresponds to the mean of all fluorescence intensities from each cell with a GFP fluorescent signal after GFP-NLS fluorescent protein delivery with the shuttle agent. FIG. 29D shows the results of a control experiment in which only single-domain peptides (ELD or CDP) or the peptide His-PTD4 (His-CPD) were used for the GFP-NLS transduction, instead of the multi-domain shuttle agents.

FIG. 30A: TAT-KALA, FIG. 30B: His-CM18-PTD4, FIG. 30C: His-C (LLKK)$_3$C-PTD4, FIG. 30D: PTD4-KALA, FIG. 30E: EB1-PTD4, and FIG. 30F: His-CM18-PTD4-His. The insets in the bottom row panels show the results of corresponding flow cytometry analyses, indicating the percentage of cells exhibiting GFP fluorescence.

FIGS. 32A-32D shows microscopy images of THP-1 cells transduced with GFP-NLS cargo protein using the shuttle His-CM18-PTD4. Images captured under at 4×,10× and 40× magnifications are shown in FIGS. 32A-32C, respectively. White triangle windows in FIG. 32C indicate examples of areas of co-labelling between cells (bright field) and GFP-NLS fluorescence. FIG. 32D shows the results of corresponding flow cytometry analyses, indicating the percentage of cells exhibiting GFP fluorescence.

FIGS. 33A-33D show microscopy images of THP-1 cells transduced with GFP-NLS cargo protein using the shuttle His-CM18-PTD4. White triangle windows indicate examples of areas of co-labelling between cells (bright field; FIGS. 33A and 33B), and GFP-NLS fluorescence (FIG. 33C and FIG. 33D).

In FIG. 34B, "Relative fluorescence intensity (FL1-A)" corresponds to the mean of all fluorescence intensities from each cell with a GFP fluorescent signal after GFP-NLS fluorescent protein delivery with the shuttle agent.

FIGS. 35A-35F shows the results of transduction efficiency experiments in which THP-1 cells were exposed daily to GFP-NLS cargo in the presence of a shuttle agent for 2.5 hours. His-CM18-PTD4 was used in FIGS. 35A-35E, and His-C(LLKK)$_3$C-PTD4 was used in FIG. 35F. GFP-NLS transduction efficiency was determined by flow cytometry at Day 1 or Day 3, and the results are expressed as the percentage of GFP fluorescent cells ("Pos cells (%)"), as well as corresponding cell viability data ("viability (%)") in FIGS. 35A-35C and 35F. FIG. 35D shows the metabolic activity index of the THP-1 cells after 1, 2, 4, and 24 h, and FIG. 35E shows the metabolic activity index of the THP-1 cells after 1 to 4 days, for cells exposed to the His-CM18-PTD4 shuttle.

FIGS. 40A-40H show fluorescence microscopy images of HeLa cells expressing mCherry™ and GFP, indicating CRISPR/Cas9-NLS-mediated cleavage of plasmid surrogate DNA. In panels A-D, HeLa cells were co-transfected with three plasmids: the plasmid surrogate as described in the brief description of FIGS. 39A-39E, and two other expression plasmids encoding the Cas9-NLS protein and crRNA1-tracrRNAs, respectively. CRISPR/Cas9-mediated cleavage of the plasmid surrogate at the STOP codon, and subsequent DNA repair by the cell, enables expression of GFP (FIGS. 40B and 40D) in addition to mCherry™ (FIGS. 40A and 40C). In FIGS. 40E-40H, HeLa cells were transfected with the plasmid surrogate and then transduced with an active CRISPR/Cas9-NLS complex using the shuttle His-CM18-PTD4. CRISPR/Cas9-NLS-mediated cleavage of the plasmid surrogate at the STOP codon, and subsequent DNA repair by the cell, enables expression of GFP (FIGS. 40F and 40H) in addition to mCherry™ (panels 40E and 40G).

FIG. 41A (lanes A to D) shows the products of a DNA cleavage assay (T7E1 assay) separated by agarose gel electrophoresis, which is used to measure CRISPR/Cas9-mediated cleavage of cellular genomic DNA. HeLa cells were transduced with a CRISPR-Cas9-NLS complex programmed to cleave the PPIB gene. The presence of the cleavage product framed in white boxes 1 and 2, indicates cleavage of the PPIB gene by the CRISPR-Cas9-NLS complex, which was delivered intracellularly using the shuttle His-C(LLKK)₃C-PTD4 (FIG. 41A, lane B) or with a lipidic transfection agent used as a positive control (FIG. 41A, lane D). This cleavage product is absent in negative controls (FIG. 41A, lanes A and C).

FIGS. 42-44 show the transcriptional activity of THP-1 cells that have been transduced with the transcription factor HOXB4 using different concentrations of the shuttle His-CM18-PTD4 and different cargo/shuttle exposure times. Successful intra-nuclear delivery of HOXB4 was determined by monitoring mRNA levels of a target gene by real-time PCR, and the results are normalized against those in the negative control (HOXB4 without shuttle agent) and expressed as "Fold over control" (left bars). Total cellular RNA (ng/µL) was quantified and used a marker for cell viability (right bars). "0" or "Ctrl" means "no treatment"; "TF" means "Transcription Factor alone"; "FS" means "shuttle alone".

FIGS. 45A-45D show fluorescence microscopy images of HeLa cells transduced with wild-type HOXB4 cargo using the shuttle His-CM18-PTD4. After a 30-minute incubation to allow transduced HOXB4-WT to accumulate in the nucleus, the cells were fixed, permeabilized and HOXB4-WT was labelled using a primary anti-HOXB4 monoclonal antibody and a fluorescent secondary antibody (FIGS. 45B and 45D). Nuclei were labelled with DAPI (FIGS. 45A and 45C). White triangle windows indicate examples of areas of co-labelling between nuclei and HOXB4-compare FIG. 45A vs 45B (×20 magnification), and FIG. 45C vs 45D (×40 magnification).

FIG. 46A shows the results with the shuttle agents: His-CM18-PTD4, His-CM18-PTD4-His, and His-C(LLKK)3C-PTD4 in HeLa cells. FIG. 46B shows the results with His-CM18-PTD4-His and His-CM18-L2-PTD4 in Jurkat cells. Negative controls (lane 4 in panels A and B) show amplified HPTR DNA sequence after incubation of the cells with the CRISPR/Cas9 complex without the presence of the shuttle agent. Positive controls (lane 5 in panels A and B) show the amplified HPTR DNA sequence after incubation of the cells with the Cas9/RNAs complex in presence of a commercial lipidic transfection agent.

FIG. 48B shows the stereotaxic coordinates of the injection site (black arrows) from the rat brain atlas of Franklin and Paxinos. The injection of GFP-NLS in presence of His-CM18-PTD4 was performed on the left part of the brain, and the negative control (injection of GFP-NLS alone), was done on the contralateral site. The black circle and connected black lines in FIG. 48B show the areas observed in the fluorescent pictures (FIGS. 48A, 48C and 48D)

FIGS. 49C-49F show predicted 3-dimensional models of the structures of the peptides FSD5, FSD18, VSVG-PTD4, and a peptide having two beta-sheets and no alpha helices, respectively.

FIG. 49G shows a multiple sequence alignment of the peptides His-CM18-PTD4; EB1-PTD4; His-C(LLKK)₃C-PTD4; FSD5; FSD10; FSD19; FSD20; FSD21; FSD44; FSD46; and FSD63, along with "Consistency" scores for each residue position. For the alignment, histidine-rich domains were voluntarily excluded.

FIGS. 50A-50C show microscopy images of live HeLa cells successfully transduced by the shuttle agent FSD5 with fluorescently labelled antibodies as cargos. FIG. 50A shows the cytoplasmic transduction of a Goat Anti-Rabbit IgG H&L (Alexa Fluor® 594) antibody visualized by bright field (upper panel) and fluorescence microscopy (lower panel) at 20× magnification. FIGS. 50B and 50C show the cytoplasmic transduction of a Goat Anti-Mouse IgG H&L (Alexa Fluor®488) antibody visualized by bright field (upper panels) and fluorescence microscopy (lower panels) at 10× and 20× magnifications, respectively.

FIGS. 52F-52I show the results of the cleavage of a targeted genomic GSK3 (FIG. 52F), CBLB (FIG. 52G) and DNMT1 (FIG. 52H-1) DNA sequence with the CRISPR/Cpf1-NLS and a single guide crRNA in the absence ("-ctrl") or presence of the shuttle agents FSD10, FSD18, FSD19 or FSD23 used at different concentrations, exposure times, and in different types of cells: NK (FIG. 52F-G); THP-1 (FIG. 52H) and primary myoblasts (FIG. 52I), after separation by agarose gel electrophoresis. Cells were incubated with CRISPR/Cpf1 complexes and FSD at the indicated times and concentrations. Thin dashed arrows indicate the bands corresponding to the target gene, and thicker solid arrows indicate the bands corresponding to the CRISPR system-mediated cleavage products of these target genes, which indicate the successful transduction of fully functional CRISPR/Cpf1-NLS genome editing complexes.

Figure 52A:
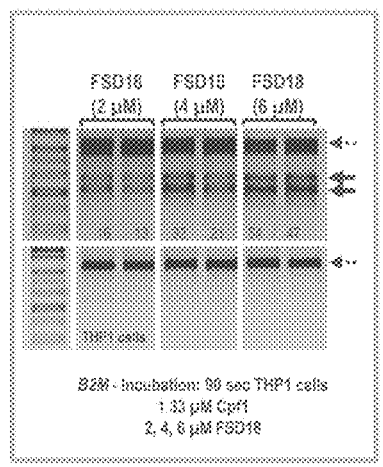
FIGS. 52A-52E show the results of the cleavage of a targeted genomic B2MDNA sequence with the CRISPR/Cas9-NLS and the crRNA/tracrRNA, or with the CRISPR/Cpf1-NLS and a single guide RNA in the absence ("-ctrl") or presence of the shuttle agents FSD10, FSD18, FSD19, FSD21, FSD23 or FSD43 used at different concentrations, exposure times, and in different types of cells: THP-1 (FIG. 52A); NK (FIG. 52B-D) and HeLa (FIG. 52E), after separation by agarose gel electrophoresis. Cells were incubated with CRISPR/Cpf1 complexes and FSD shuttle agents at the indicated times and concentrations. Thin dashed arrows indicate the bands corresponding to the target gene, and thicker solid arrows indicate the bands corresponding to the CRISPR system-mediated cleavage products of this target gene, which indicate the successful transduction of fully functional CRISPR/Cas9-NLS genome editing complexes. An imaging software was used to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thick solid arrows).
Figure 52B:
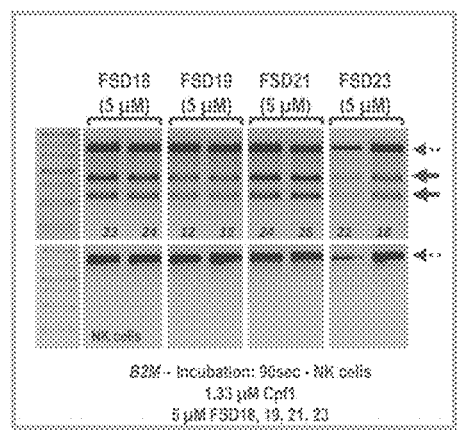
Figure 52C:
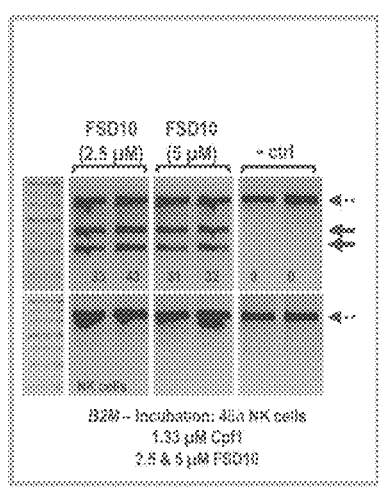

or presence of the shuttle agents FSD10, FSD21, FSD22 or FSD23 used at different concentrations, exposure times, and in NK cells (FIG. 52F-52G) and NK-92 cells (FIG. 52H), after separation by agarose gel electrophoresis. Cells were incubated with CRISPR/Cpf1 complexes for the indicated incubation times and concentrations. Thin dashed arrows indicate the bands corresponding to the target gene, and thicker solid arrows indicate the bands corresponding to the CRISPR system-mediated cleavage products of this target gene, which indicate the successful transduction of fully functional CRISPR/Cpf1-NLS genome editing complexes.

FIGS. 53A-53G show the results of the cleavage of the targeted genomic HPRT, DNMT1 and B2M DNA sequences with CRISPR systems. The two genomic HPRT (FIG. 53A) and DNMT1 (FIG. 53B) DNA sequences or two DNA loci on the genomic B2M exon 2 (FIG. 53C-D) were targeted in HeLa cells using CRISPR/Cas9-NLS and CRISPR/Cpf1-NLS genome editing complexes designed for those purposes, which were transduced using the shuttle agent peptide FSD18. The two DNA loci on the genomic B2M exon 2 (FIG. 53E-G) were targeted in NK cells with the CRISPR/Cpf1-NLS and single guide crRNA-1, crRNA-2 or both, in the absence ("-ctrl") or presence of the shuttle agents FSD10 (FIG. 53E), FSD21 (FIG. 53F) or FSD23 (FIG. 53G) used at different concentrations and exposure times after separation by agarose gel electrophoresis. Thin dashed arrows indicate the bands corresponding to the target gene, and thicker solid arrows indicate the bands corresponding to the CRISPR/Cpf1-mediated cleavage products in presence of the crRNA-1 or crRNA2 or both (crRNA1+2) for the B2M exon 2, which indicate the successful transduction of fully functional CRISPR/Cpf1-NLS genome editing complexes.

FIGS. 54A-54D show the results of flow cytometry assays in which T cells were treated with increasing concentrations of the shuttle agent FSD21 (8 µM in FIG. 54B, 10 µM in FIG. 54C, and 12 µM in FIG. 54D), 1.33 µM of CRISPR/Cpf1-NLS system and 2 µM of single guide crRNA targeting a B2M genomic DNA sequence. HLA-positive and HLA-negative (B2M knock-out) cells were identified 72 hours after treatment by using an APC-labeled Mouse Anti-Human HLA-ABC antibody. Left-shifted cell populations indicated successful inactivation of cell surface HLA receptors, resulting from inactivation of the B2M gene.

FIGS. 55A-55D show the results of flow cytometry assays in which T cells were treated with increasing concentrations of the shuttle agent FSD18 (8 µM in FIG. 55B, 10 µM in FIG. 55C, and 12 µM in FIG. 55D), 1.33 µM of CRISPR/Cpf1-NLS system and 2 µM of single guide crRNA targeting a B2M DNA sequence. HLA-positive and HLA-negative (B2M knock-out) cells were identified 72 hours after treatment by using an APC-labeled Mouse Anti-Human HLA-ABC antibody. Left-shifted cell populations indicated successful inactivation of cell surface HLA receptors, resulting from inactivation of the B2M gene.

Figure 56A:
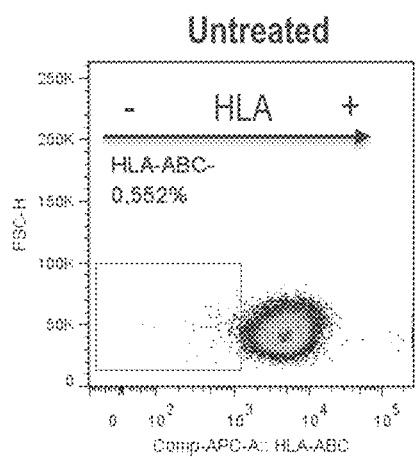
Figure 56B:
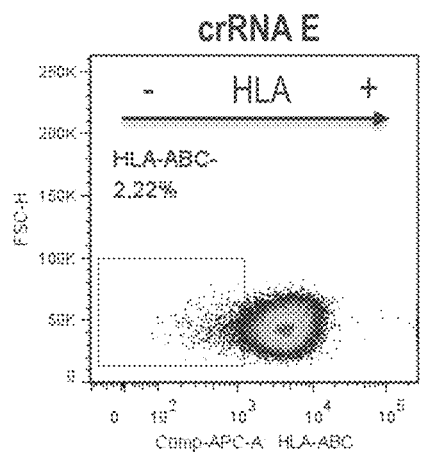
Figure 56C:
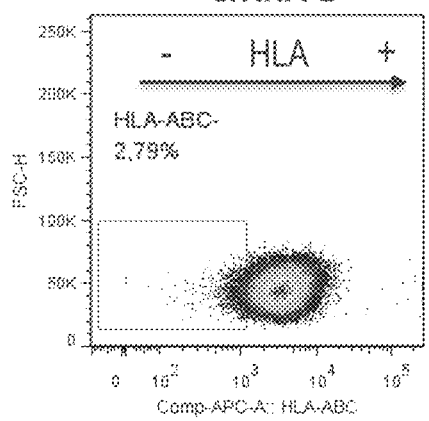
Figure 56D:
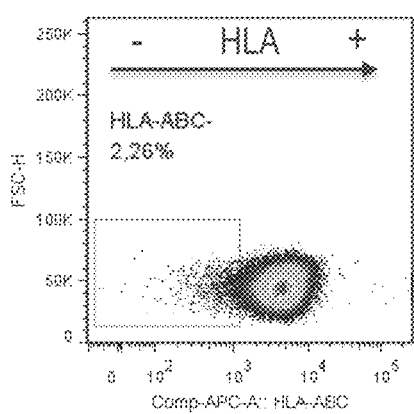
Figure 56E:
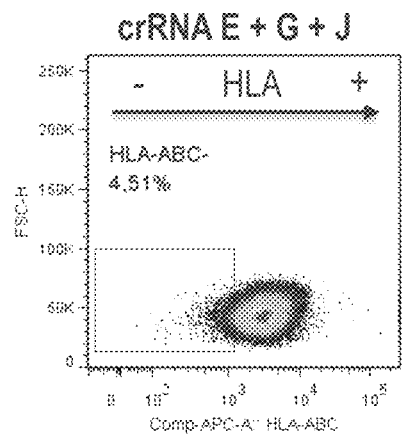

FIGS. 56A-56E show the results of flow cytometry assays in which THP-1 cells were treated (FIG. 56B-56E) or not ("untreated", FIG. 56A) with a mixture of 1.33 µM of CRISPR/Cpf1-NLS system, 2 µM of one or three guide crRNA each targeting different sites within the B2M genomic DNA sequence and 3 µM of FSD18. HLA-positive and HLA-negative (B2M knock-out) cells were identified 48 hours after treatment by using an APC-labeled Mouse Anti-Human HLA-ABC antibody in untreated cells (FIG. 56A), crRNA E treated cells (FIG. 56B), crRNA G treated cells (FIG. 56C), crRNA J treated cells (FIG. 56D) and crRNA E+G+J treated cells (FIG. 56E). Left-shifted cell populations indicated successful inactivation of cell surface HLA receptors, resulting from inactivation of the B2M gene.

Figure 57A:
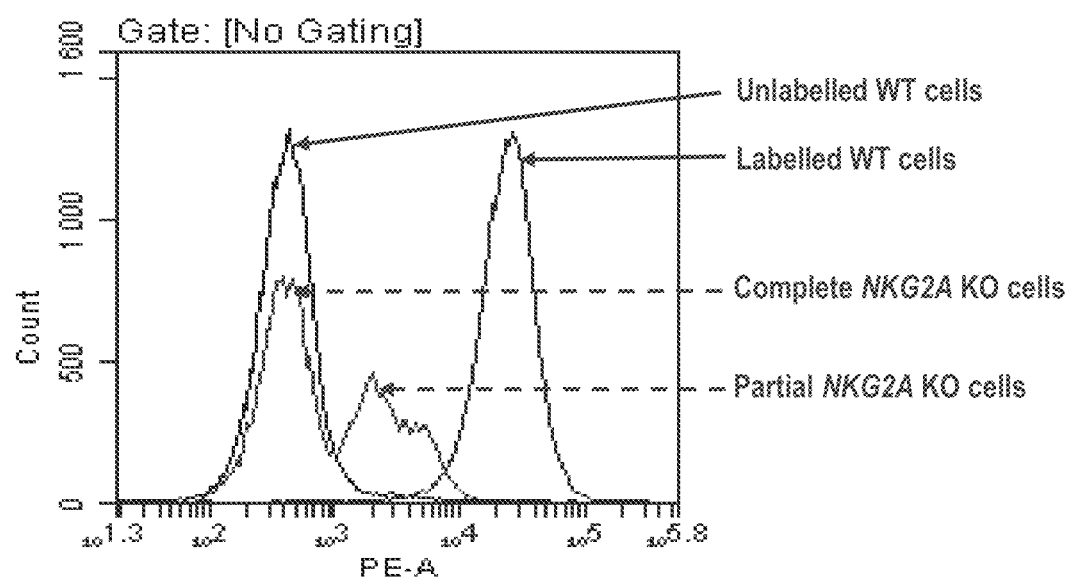
Figure 57B:
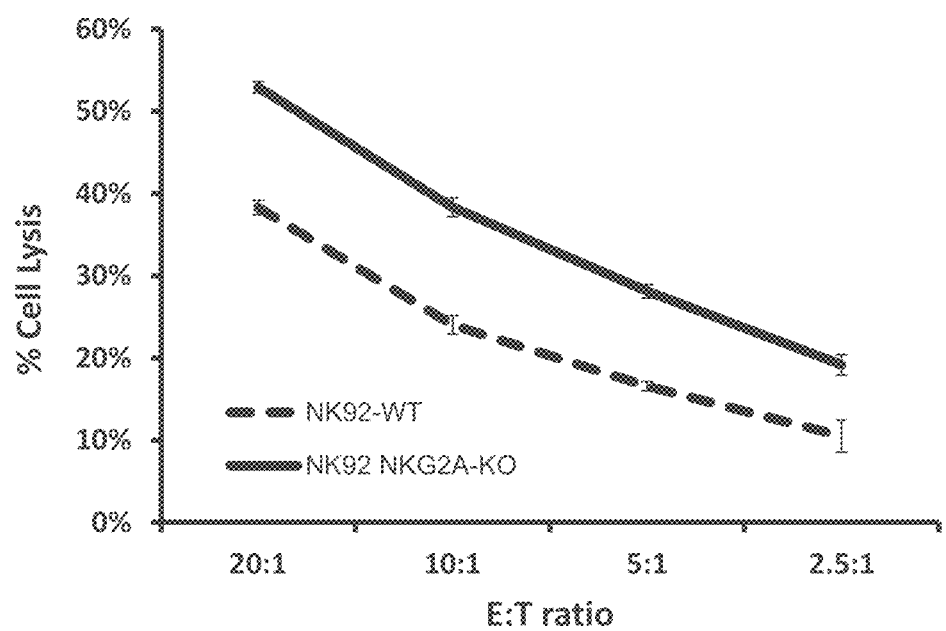

FIGS. 57A and 57B show the results of experiments in which NK-92 cells were genome-edited to determine whether inactivation of the endogenous NKG2A gene could increase their ability to kill target HeLa cells. Briefly, NK-92 cells were transduced with a CRISPR/Cpf1-NLS genome editing complex designed to cleave the NKG2A gene using the shuttle agent peptide FSD23. After transduction, NK-92 cells were immunolabelled with a phycoerythrin (PE)-labelled anti-NKG2A antibody and then analyzed by flow cytometry as shown in FIG. 57A, to verify successful inactivation of NKG2A. As controls, unlabelled wild-type NK-92 cells ("unlabelled WT cells") had no antibody signal, and labelled wild-type NK-92 cells ("labelled WT cells") had full immunolabelling signal. For NKG2A-KO NK-92 cells, two cell populations (peaks) were observed: one with a complete knock-out of NKG2A receptor expression on the cell surface ("Complete NKG2A KO cells"), and the other with a partial lack of expression ("Partial NKG2A KO cells"). FIG. 57B shows the results of cytotoxicity assays in which target HeLa cells previously loaded with an intracellular fluorescent dye (calcein) were exposed to either wild-type (solid line) or genome edited NKG2A-KO (dotted line) effector NK-92 cells, at different Effector:Target ratios (E:T ratio). Cytotoxicity was evaluated by the relative release of intracellular calcein into the extracellular space resulting from disruption of the cell membranes of the target HeLa cells (% cell lysis").

Figure 58D:
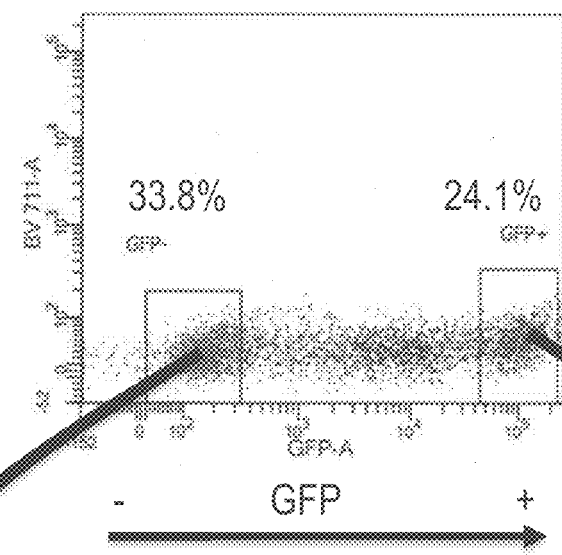
Figure 58E:
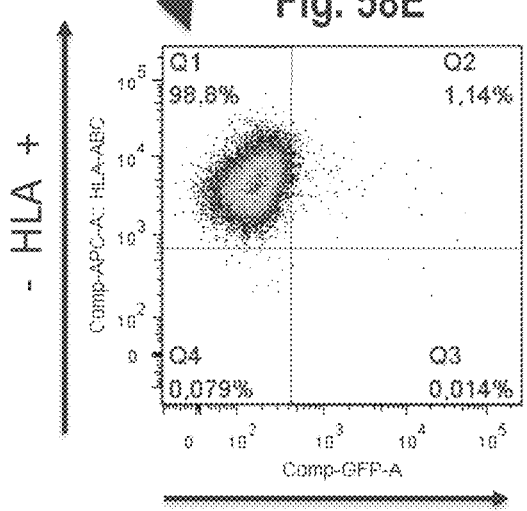
Figure 58F:
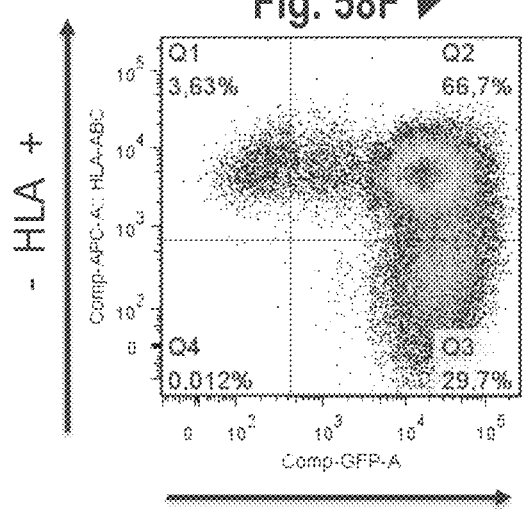

FIGS. 58A-58F show the results of flow cytometry assays in which T cells were treated (FIG. 58A-58F) or not ("untreated", FIG. 58A) with a mixture of GFP-NLS, a CRISPR/Cpf1-NLS complex designed to cleave the B2M genomic DNA sequence, and the shuttle agent FSD18. FIGS. 58B and 58C show the results of a two-dimensional flow cytometry analysis 5 h after treatment based on GFP fluorescence (x-axis) and cell surface HLA expression (y-axis). Fluorescence-activated cell sorting (FIG. 58D) of cells based on their GFP-fluorescence into a GFP-negative fraction (FIG. 58E) and a GFP-positive fraction (FIG. 58F) resulted in an increase in the proportion of genome-edited (HLA-negative) cells to 29.7% in the GFP-positive fraction (FIG. 58F). Each cell fraction was then subjected to a standard T7E1 cleavage assay followed by agarose gel electrophoresis to evaluate the effectiveness of the genome editing. The results are shown in FIG. 58G, wherein thin dashed arrows indicate the bands corresponding to the target gene, and thicker solid arrows indicate the bands corresponding to the CRISPR system-mediated cleavage products of this target gene. The values at the bottom of lanes 2, 3 and 4 correspond to the relative signal intensities (%) of the cleavage product bands (solid arrows) in that lane.

Figure 59A:
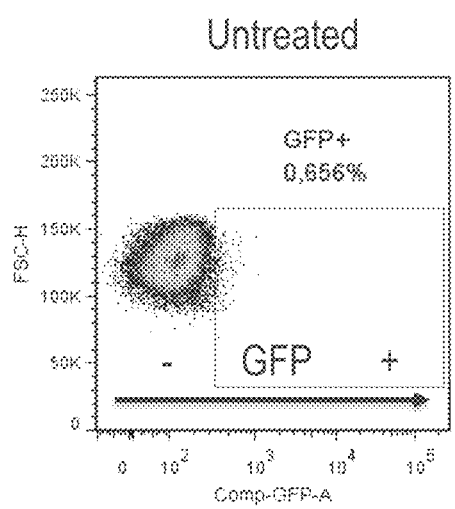
Figure 59B:
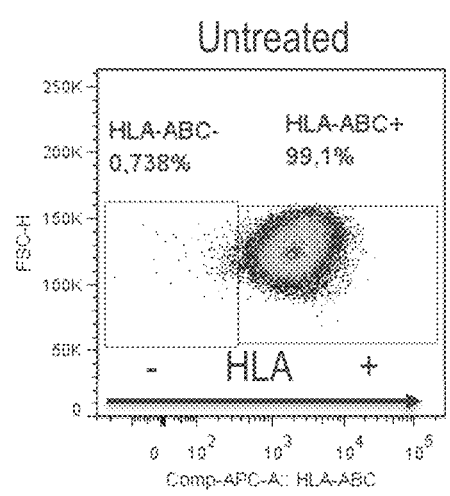

FIGS. 59A-59E show the results of flow cytometry assays in which T cells were treated (FIG. 59C-59E) or not ("untreated", FIGS. 59A and 59B) with a mixture GFP-NLS, a CRISPR/Cpf1-NLS complex designed to cleave the endogenous B2M gene, and the shuttle agent FSD18. FIGS. 59A and 59B, show the results of "untreated" negative control cells not exposed to the peptide shuttle agent, GFP, nor CRISPR/Cpf1, which were analyzed by flow cytometry for GFP fluorescence (FIG. 59A) and cell surface HLA expression (FIG. 59B). T cells were co-transduced with both GFP-NLS and CRISPR/Cpf1 via the peptide FSD18, and the resulting GFP fluorescence distribution is shown in FIG. 59C. The two gates shown in FIG. 59C indicate the fraction of cells that were considered to be GFP-positive ("GFP+"; 93.2%; solid gate) and the sub-fraction of cells that were considered as exhibiting high GFP fluorescence ("GFP high"; 33.1%; dotted gate). Fluorescence-activated cell sorting was performed to quantify the level of cell surface HLA expression in cells considered to be GFP-positive (FIG. 59D) as compared to cells considered as exhibiting high GFP fluorescence (FIG. 59E). The above co-transduction experiment was repeated using 12 μM or 15 μM FSD18, followed by fluorescence-activated cell sorting into GFP-positive and GFP-negative cell fractions. Each fraction was subjected to a standard T7E1 cleavage assay, and the different samples were subjected to agarose gel electrophoresis.

FIG. 60 shows the results of a flow cytometry analysis in which T cells were subjected to a first transduction (FIG. 60B) or not ("untreated", FIG. 60A) with the cargo GFP-NLS using the peptide FSD18. The first transduction resulted in a GFP-NLS transduction efficiency of 55.4% (FIG. 60B). Fluorescence-activated cell sorting was performed to isolate GFP-negative cells (FIG. 60C) following the first transduction, and this GFP-negative cell population was subjected to a second transduction with GFP-NLS using the peptide FSD18. The results from this second transduction are shown in FIG. 60D, in which the GFP-NLS transduction efficiency was found to be 60.6%.

SEQUENCE LISTING

This application contains a Sequence Listing in computer readable form amended Feb. 24, 2022 having a size of about 5 MB. The computer readable form is incorporated herein by reference.

| SEQ ID NO: | Description |
| --- | --- |
| 1 | CM18 |
| 2 | Diphtheria toxin T domain (DT) |
| 3 | GALA |
| 4 | PEA |
| 5 | INF-7 |
| 6 | LAH4 |
| 7 | HGP |
| 8 | H5WYG |
| 9 | HA2 |
| 10 | EB1 |
| 11 | VSVG |
| 12 | Pseudomonas toxin |
| 13 | Melittin |
| 14 | KALA |
| 15 | JST-1 |
| 16 | SP |
| 17 | TAT |
| 18 | Penetratin (Antennapedia) |
| 19 | pVEC |
| 20 | M918 |
| 21 | Pep-1 |
| 22 | Pep-2 |
| 23 | Xentry |
| 24 | Arginine stretch |
| 25 | Transportan |
| 26 | SynB1 |
| 27 | SynB3 |
| 28 | E1a |
| 29 | SV40 T-Ag |
| 30 | c-myc |
| 31 | Op-T-NLS |
| 32 | Vp3 |
| 33 | Nucleoplasmin |
| 34 | Histone 2B NLS |
| 35 | Xenopus N1 |
| 36 | PARP |
| 37 | PDX-1 |
| 38 | QKI-5 |
| 39 | HCDA |
| 40 | H2B |
| 41 | v-Rel |
| 42 | Amida |
| 43 | RanBP3 |
| 44 | Pho4p |
| 45 | LEF-1 |
| 46 | TCF-1 |
| 47 | BDV-P |
| 48 | TR2 |
| 49 | SOX9 |
| 50 | Max |
| 51 | Mitochondrial signal sequence from Tim9 |
| 52 | Mitochondrial signal sequence from Yeast cytochrome c oxidase subunit IV |
| 53 | Mitochondrial signal sequence from 18S rRNA |
| 54 | Peroxisome signal sequence—PTS1 |
| 55 | Nucleolar signal sequence from BIRC5 |
| 56 | Nucleolar signal sequence from RECQL4 |
| 57 | CM18-TAT |
| 58 | CM18-Penetratin |
| 59 | His-CM18-TAT |
| 60 | GFP |
| 61 | TAT-GFP |
| 62 | GFP-NLS |
| 63 | C(LLKK)3C |
| 64 | G(LLKK)3G |
| 65 | PTD4 |
| 66 | TAT-CM18 |
| 67 | TAT-KALA |
| 68 | His-CM18-PTD4 |
| 69 | His-CM18-9Arg |
| 70 | His-CM18-Transportan |
| 71 | His-LAH4-PTD4 |
| 72 | His-C(LLKK)3C-PTD4 |
| 73 | mCherryTM-NLS |
| 74 | Cas9-NLS |
| 75 | crRNA (Example 13.3) |
| 76 | tracrRNA (Example 13.3) |
| 77 | Feldan tracrRNA (Example 13.5, 13.6) |
| 78 | PPIB crRNA (Example 13.5) |
| 79 | Dharmacon tracrRNA (Example 13.5) |
| 80 | HOXB4-WT |
| 81 | His-PTD4 |
| 82 | PTD4-KALA |
| 83 | 9Arg-KALA |
| 84 | Pep1-KALA |
| 85 | Xentry-KALA |
| 86 | SynB3-KALA |
| 87 | VSVG-PTD4 |
| 88 | EB1-PTD4 |
| 89 | JST-PTD4 |
| 90 | CM18-PTD4 |
| 91 | 6Cys-CM18-PTD4 |
| 92 | CM18-L1-PTD4 |
| 93 | CM18-L2-PTD4 |
| 94 | CM18-L3-PTD4 |
| 95 | His-CM18-TAT |
| 96 | His-CM18-PTD4-6Cys |
| 97 | 3His-CM18-PTD4 |
| 98 | 12His-CM18-PTD4 |
| 99 | HA-CM18-PTD4 |
| 100 | 3HA-CM18-PTD4 |
| 101 | CM18-His-PTD4 |
| 102 | His-CM18-PTD4-His |
| 103 | HPRT crRNA (Example 13.6) |
| 104-129 | FSD1-FSD26 |
| 130-137 | FSN1-FSN8 |
| 138-153 | FSD27-FSD42 |
| 154 | Short DNA template |
| 155 | Cpf1-NLS |

-continued

| SEQ ID NO: | Description |
|---|---|
| 156 | GFP coding DNA template |
| 157 | DNMT1 crRNA |
| 158 | LKLWXRXLKXXXXG motif |
| 159 | RRXXAKXA motif |
| 160 | B2M crRNA (Cas9) |
| 161 | B2M exon 2 crRNA-1 (Cpf1) |
| 162 | B2M exon 2 crRNA-2 (Cpf1) |
| 163 | CBLB crRNA |
| 164 | GSK3 crRNA |
| 165 | NKG2A crRNA |
| 166 | B2M crRNA-E |
| 167 | B2M crRNA-J |
| 168 | B2M crRNA-G |
| 169-242 | FSD43-FSD116 |
| 243-10 242 | Computer-generated peptide variants that respect design parameters described herein |
| 10 243 | GGS |
| 10 244 | |

DETAILED DESCRIPTION

Large-scale screening efforts led to the discovery that domain-based peptide shuttle agents, comprising an endosome leakage domain (ELD) operably linked to a cell penetrating domain (CPD), and optionally one or more histidine-rich domains, can increase the transduction efficiency of an independent polypeptide cargo in eukaryotic cells, such that the cargo gains access to the cytosol/nuclear compartment (e.g., see Examples 1-15). Conversely, the above screening efforts also revealed some peptides having no or low polypeptide cargo transduction power, excessive toxicity, and/or other undesirable properties (e.g., poor solubility and/or stability).

Based on these empirical data (both positive and negative), the amino acid sequences and properties of successful, less successful, and failed peptides were compared in order to better understand the physicochemical properties common to the more successful shuttle agents. This comparison involved two main approaches: First, manually stratifying the different screened peptides according to their transduction performance, based on our complied biological characterization data; and second, a more simplified "transduction score" approach, which considered only the transduction efficiency and cellular toxicity of the different peptides, for a given polypeptide cargo and cell line.

For manual stratification, the screened peptides were evaluated individually according to their transduction performance, with due consideration to, for example: their solubility/stability/ease of synthesis; their ability to facilitate escape of endosomally-trapped calcein (e.g., see Example 2); their ability to deliver one or more types of independent polypeptide cargos intracellularly, as evaluated by flow cytometry (e.g., see Examples 3-6 and 8-15) in different types of cells and cell lines (e.g., primary, immortalized, adherent, suspension, etc.) as well as under different transduction protocols; their ability to deliver polypeptide cargos to the cytosol and/or nucleus, as evaluated by fluorescence microscopy (e.g., for fluorescently labelled cargos), increased transcriptional activity (e.g., for transcription factor cargos), or genome editing capabilities (e.g., for nuclease cargos or genome-editing complexes such as CRISPR/Cas9 or CRISPR/Cpf1) (e.g., see Examples 3-6 and 8-15), and toxicity towards different types of cells and cell lines (e.g., primary, immortalized, adherent, suspension, etc.), under different transduction protocols.

For the "transduction score" approach, each peptide was assigned a score corresponding to a given cell line and fluorescently-labelled polypeptide cargo, which combines both transduction efficiency and cellular toxicity data into a single numerical value. The transduction scores were calculated by simply multiplying the highest percentage transduction efficiency observed by flow cytometry for a given peptide, cargo and cell type by the percentage cellular viability for the peptide in the tested cell line. The peptides were then sorted according to their transduction scores as a screening tool to stratify peptides as successful, less successful, or failed shuttle agents.

The above-mentioned manual curation and "transduction score"-based analyses revealed a number of parameters that are generally shared by successful domain-based shuttle agents (e.g. see Example A). These parameters were then successfully used to manually design new peptide shuttle agents having polypeptide cargo transduction activity, which lack and/or are not based on known putative CPDs and/or ELDs (e.g., see Example B). Furthermore, it was observed that peptides satisfying the most number of design parameters had generally the highest transduction scores, while peptides satisfying the least number of design parameters had generally the lowest transduction scores. The design parameters described herein were further validated by testing a plurality of synthetic peptides whose amino acid sequences were generated using a machine learning algorithm (e.g., see Example C.1), the algorithm having been "trained" using transduction efficiency and cellular toxicity data of domain-based peptides (but not the design parameters described herein). Interestingly, the peptides generated by the machine learning algorithm demonstrating the highest transduction scores were generally peptides that satisfied all of the design parameters described herein, thereby substantiating their use in actively designing and/or predicting the transduction activity of new peptide shuttle agents (e.g., tailored to particular polypeptide cargos and/or types of cells). Furthermore, computer-assisted random peptide sequence generation followed by descriptors filtering was used to generate a list of 10 000 peptide variants that respect nearly all of the design parameters described herein (see Example C.2).

Rationally-designed peptide shuttle agents are shown herein to facilitate escape of an endosomally trapped fluorescent dye, suggesting endosomolytic activity (e.g., see Example D). Furthermore, the ability of rationally-designed peptide shuttle agents to transduce a variety of polypeptide cargos (e.g., fluorescent proteins, transcription factors, antibodies, as well as entire CRISPR-associated genome editing complexes, with or without a DNA template) in a variety of different cell types (both adherent and suspension) is also shown herein (e.g., see Examples E-G).

Rational Design Parameters and Peptide Shuttle Agents

In some aspects, the present description relates to a method for delivering a polypeptide cargo from an extracellular space to the cytosol and/or nucleus of a target eukaryotic cell. The method comprises contacting the target eukaryotic cell with the polypeptide cargo in the presence of a shuttle agent at a concentration sufficient to increase the transduction efficiency of said polypeptide cargo, as compared to in the absence of the shuttle agent. In some aspects, the shuttle agent relates to a peptide that satisfies one or more of the following parameters:

(1) In some embodiments, the shuttle agent is a peptide at least 20 amino acids in length. For example, the peptide may comprise a minimum length of 20, 21, 22, 23, 24, 25, 26, 27, 28, 29, or 30 amino acid residues, and a maximum length of 35, 36, 37, 38, 39, 40, 41, 42, 43, 44, 45, 46, 47, 48, 49, 50, 51, 52, 53, 54, 55, 60, 65, 70, 75, 80, 85, 90, 95, 100, 105, 110, 115, 120, 125, 130, 135, 140, 145, or 150 amino acid residues. In some embodiments, shorter peptides (e.g., in the 20-50 amino acid range) may be particularly advantageous because they may be more easily synthesized and purified by chemical synthesis approaches, which may be more suitable for clinical use (as opposed to recombinant proteins that must be purified from cellular expression systems). While numbers and ranges in the present description are often listed as multiples of 5, the present description should not be so limited. For example, the maximum length described herein should be understood as also encompassing a length of 56, 57, 58 . . . 61, 62, etc., in the present description, and that their non-listing herein is only for the sake of brevity. The same reasoning applies to the % of identities listed herein.

(2) In some embodiments, the peptide shuttle agent comprises an amphipathic alpha-helical motif. As used herein, the expression "alpha-helical motif" or "alpha-helix", unless otherwise specified, refers to a right-handed coiled or spiral conformation (helix) having angle of rotation between consecutive amino acids of 100 degrees and/or an alpha-helix having 3.6 residues per turn. As used herein, the expression "comprises an alpha-helical motif" or "an amphipathic alpha-helical motif" and the like, refers to the three-dimensional conformation that a peptide (or segment of a peptide) of the present description is predicted to adopt when in a biological setting based on the peptide's primary amino acid sequence, regardless of whether the peptide actually adopts that conformation when used in cells as a shuttle agent. Furthermore, the peptides of the present description may comprise one or more alpha-helical motifs in different locations of the peptide. For example, the shuttle agent FSD5 is predicted to adopt an alpha-helix over the entirety of its length (see FIG. 49C), while the shuttle agent FSD18 is predicted to comprise two separate alpha-helices towards the N and C terminal regions of the peptide (see FIG. 49D). In some embodiments, the shuttle agents of the present description are not predicted to comprise a beta-sheet motif, for example as shown in FIGS. 49E and 49F. Methods of predicting the presence of alpha-helices and beta-sheets in proteins and peptides are well known in the art. For example, one such method is based on 3D modeling using PEP-FOLD™, an online resource for de novo peptide structure prediction (http://bioserv.rpbs.univ-paris-diderot.fr/services/PEP-FOLD/) (Lamiable et al., 2016; Shen et al., 2014; Thevenet et al., 2012). Other methods of predicting the presence of alpha-helices in peptides and protein are known and readily available to the skilled person.

As used herein, the expression "amphipathic" refers to a peptide that possesses both hydrophobic and hydrophilic elements (e.g., based on the side chains of the amino acids that comprise the peptide). For example, the expression "amphipathic alpha helix" or "amphipathic alpha-helical motif" refers to a peptide predicted to adopt an alpha-helical motif having a non-polar hydrophobic face and a polar hydrophilic face, based on the properties of the side chains of the amino acids that form the helix.

(3) In some embodiments, peptide shuttle agents of the present description comprise an amphipathic alpha-helical motif having a positively-charged hydrophilic outer face, such as one that is rich in R and/or K residues. As used herein, the expression "positively-charged hydrophilic outer face" refers to the presence of at least three lysine (K) and/or arginine (R) residues clustered to one side of the amphipathic alpha-helical motif, based on alpha-helical wheel projection (e.g., see FIG. 49A, left panel). Such helical wheel projections may be prepared using a variety of programs, such as the online helical wheel projection tool available at: http://rzlab.ucr.edu/scripts/wheel/wheel.cgi. In some embodiments, the amphipathic alpha-helical motif may comprise a positively-charged hydrophilic outer face that comprises: (a) at least two, three, or four adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn.

In some embodiments, peptide shuttle agents of the present description comprise an amphipathic alpha-helical motif comprising a hydrophobic outer face, the hydrophobic outer face comprising: (a) at least two adjacent L residues upon helical wheel projection; and/or (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn.

Figure 49A:
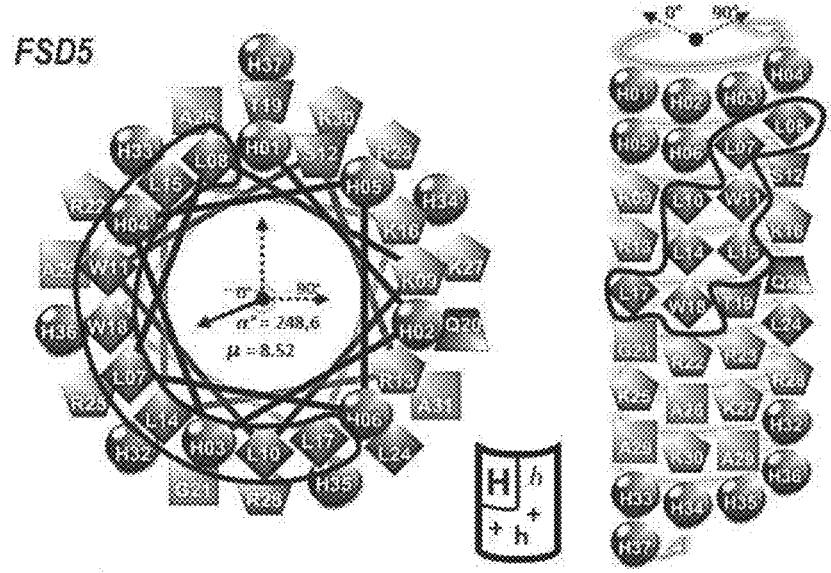
FIGS. 49A and 49B show helical wheel (left panels) and "open cylinder" (right panels) representations of the peptides FSD5 and VSVG-PTD4, respectively. The geometrical shape of each amino acid residue corresponds to its biochemical property based on the residue's side chain (i.e., hydrophobicity, charge, or hydrophilicity). One of the main differences between the two opened cylindrical representations of FSD5 and VSVG-PTD4 is the presence of a highly hydrophobic core in FSD5 (outlined in FIG. 49A, left and right panels), which is not present in VSVG-PTD4. The cylinder in the lower middle panels of FIGS. 49A and 49B represent simplified versions of the opened cylindrical representations in the right panels, in which: "H" represents the high hydrophobic surface area; "h" represents low hydrophobic surface area; "+" represents positively charged residues; and "h" represent hydrophilic residues.

(4) In some embodiments, peptide shuttle agents of the present description comprise an amphipathic alpha-helical motif having a highly hydrophobic core composed of spatially adjacent highly hydrophobic residues (e.g., L, I, F, V, W, and/or M). In some embodiments, the highly hydrophobic core may consist of spatially adjacent L, I, F, V, W, and/or M amino acids representing 12 to 50% of the amino acids of the peptide, calculated while excluding any histidine-rich domains (see below), based on an open cylindrical representation of the alpha-helix having 3.6 residues per turn, as shown for example in FIG. 49A, right panel. In some embodiments, the highly hydrophobic core may consist of spatially adjacent L, I, F, V, W, and/or M amino acids representing from 12.5%, 13%, 13.5%, 14%, 14.5%, 15%, 15.5%, 16%, 16.5%, 17%, 17.5%, 18%, 18.5%, 19%, 19.5%, or 20%, to 25%, 30%, 35%, 40%, or 45% of the amino acids of the peptide. More particularly, highly hydrophobic core parameter may be calculated by first arranging the amino acids of the peptide in an opened cylindrical representation, and then delineating an area of contiguous highly hydrophobic residues (L, I, F, V, W, M), as shown in FIG. 49A, right panel. The number of highly hydrophobic residues comprised in this delineated highly hydrophobic core is then divided by the total amino acid length of the peptide, excluding any histidine-rich domains (e.g., N- and/or C-terminal histidine-rich domains). For example, for the peptide shown in FIG. 49A, there are 8 residues in the delineated highly hydrophobic core, and 25 total residues in the peptide (excluding the terminal 12 histidines). Thus, the highly hydrophobic core is 32% (8/25).

(5) Hydrophobic moment relates to a measure of the amphiphilicity of a helix, peptide, or part thereof, calculated from the vector sum of the hydrophobicities of the side chains of the amino acids (Eisenberg et al., 1982). An online tool for calculating the hydrophobic moment of a polypeptide is available from: http://rzlab.ucr.edu/scripts/wheel/wheel.cgi. A high hydrophobic moment indicates strong amphiphilicity, while a low hydrophobic moment indicates poor amphiphilicity. In some embodiments, peptide shuttle agents of the present description may consist of or comprise a peptide or alpha-helical domain having have a hydrophobic moment ($\mu$) of 3.5 to 11. In some embodiments, the shuttle agent may be a peptide comprising an amphipathic alpha-helical motif having a hydrophobic moment between a lower limit of 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, 10.5, 10.6, 10.7, 10.8, 10.9, or 11.0. In some embodiments, the shuttle agent may be a peptide having a hydrophobic moment between a lower limit of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, or 10.5. In some embodiments, the hydrophobic moment is calculated excluding any histidine-rich domains that may be present in the peptide.

(6) In some embodiments, peptide shuttle agents of the present description may have a predicted net charge of at least+4 at physiological pH, calculated from the side chains of K, R, D, and E residues. For example, the net charge of the peptide may be at least+5, +6, +7, at least+8, at least+9, at least+10, at least+11, at least+12, at least+13, at least +14, or at least+15 at physiological pH. These positive charges are generally conferred by the greater presence of positively-charged lysine and/or arginine residues, as opposed to negatively charged aspartate and/or glutamate residues.

(7) In some embodiments, peptide shuttle agents of the present description may have a predicted isoelectric point ($\mu$I) of 8 to 13, preferably from 10 to 13. Programs and methods for calculating and/or measuring the isoelectric point of a peptide or protein are known in the art. For example, pI may be calculated using the Prot Param software available at: http://web.expasy.org/protparam/

(8) In some embodiments, peptide shuttle agents of the present description may be composed of 35 to 65% of hydrophobic residues (A, C, G, I, L, M, F, P, W, Y, V). In particular embodiments, the peptide shuttle agents may be composed of 36% to 64%, 37% to 63%, 38% to 62%, 39% to 61%, or 40% to 60% of any combination of the amino acids: A, C, G, I, L, M, F, P, W, Y, and V.

(9) In some embodiments, peptide shuttle agents of the present description may be composed of 0 to 30% of neutral hydrophilic residues (N, Q, S, T). In particular embodiments, the peptide shuttle agents may be composed of 1% to 29%, 2% to 28%, 3% to 27%, 4% to 26%, 5% to 25%, 6% to 24%, 7% to 23%, 8% to 22%, 9% to 21%, or 10% to 20% of any combination of the amino acids: N, Q, S, and T.

(10) In some embodiments, peptide shuttle agents of the present description may be composed of 35 to 85% of the amino acids A, L, K and/or R. In particular embodiments, the peptide shuttle agents may be composed of 36% to 80%, 37% to 75%, 38% to 70%, 39% to 65%, or 40% to 60% of any combination of the amino acids: A, L, K, or R.

(11) In some embodiments, peptide shuttle agents of the present description may be composed of 15 to 45% of the amino acids A and/or L, provided there being at least 5% of L in the peptide. In particular embodiments, the peptide shuttle agents may be composed of 15% to 40%, 20% to 40%, 20 to 35%, or 20 to 30% of any combination of the amino acids: A and L, provided there being at least 5% of L in the peptide.

(12) In some embodiments, peptide shuttle agents of the present description may be composed of 20 to 45% of the amino acids K and/or R. In particular embodiments, the peptide shuttle agents may be composed of 20% to 40%, 20 to 35%, or 20 to 30% of any combination of the amino acids: K and R.

(13) In some embodiments, peptide shuttle agents of the present description may be composed of 0 to 10% of the amino acids D and/or E. In particular embodiments, the peptide shuttle agents may be composed of 5 to 10% of any combination of the amino acids: D and E.

(14) In some embodiments, the absolute difference between the percentage of A and/or L and the percentage of K and/or R in the peptide shuttle agent may be less than or equal to 10%. In particular embodiments, the absolute difference between the percentage of A and/or L and the percentage of K and/or R in the peptide shuttle agent may be less than or equal to 9%, 8%, 7%, 6%, or 5%.

(15) In some embodiments, peptide shuttle agents of the present description may be composed of 10% to 45% of the amino acids Q, Y, W, P, I, S, G, V, F, E, D, C, M, N, T, or H (i.e., not A, L, K, or R). In particular embodiments, the peptide shuttle agents may be composed of 15 to 40%, 20% to 35%, or 20% to 30% of any combination of the amino acids: Q, Y, W, P, I, S, G, V, F, E, D, C, M, N, T, and H.

In some embodiments, peptide shuttle agents of the present description respect at least one, at least two, at least three, at least four, at least five, at least six, at least seven, at least eight, at least nine, at least ten, at least eleven, at least twelve, at leave thirteen, at least fourteen, or all of parameters (1) to (15) described herein. In particular embodiments, peptide shuttle agents of the present description respect all of parameters (1) to (3), and at least six, at least seven, at least eight, at least nine, at least ten, at least eleven, or all of parameters (4) to (15) described herein.

In some embodiments, where a peptide shuttle agent of the present description comprises only one histidine-rich domain, the residues of the one histidine-rich domain may be included in the calculation/assessment of parameters (1) to (15) described herein. In some embodiments, where a peptide shuttle agent of the present description comprises more than one histidine-rich domain, only the residues of one of the histidine-rich domains may be included in the calculation/assessment of parameters (1) to (15) described herein. For example, where a peptide shuttle agent of the present description comprises two histidine-rich domains: a first histidine-rich domain towards the N terminus, and a second histidine-rich domain towards the C terminus, only the first histidine-rich domain may be included in the calculation/assessment of parameters (1) to (15) described herein.

In some embodiments, a machine-learning or computer-assisted design approach may be implemented to generate peptides that respect one or more of parameters (1) to (15)

described herein. Some parameters, such as parameters (1) and (5)-(15), may be more amenable to implementation in a computer-assisted design approach, while structural parameters, such as parameters (2), (3) and (4), may be more amenable to a manual design approach. Thus, in some embodiments, peptides that respect one or more of parameters (1) to (15) may be generated by combining computer-assisted and manual design approaches. For example, multiple sequence alignment analyses of a plurality of peptides shown herein (and others) to function as effective shuttle agents revealed the presence of some consensus sequences—i.e., commonly found patterns of alternance of hydrophobic, cationic, hydrophilic, alanine and glycine amino acids. The presence of these consensus sequences are likely to give rise to structural parameters (2), (3) and (4) being respected (i.e., amphipathic alpha-helix formation, a positively-charged face, and a highly hydrophobic core of 12%-50%). Thus, these and other consensus sequences may be employed in machine-learning and/or computer-assisted design approaches to generate peptides that respect one or of parameters (1)-(15).

Accordingly, in some embodiments, peptide shuttle agents described herein may comprise or consist of the amino acid sequence of:

(a) [X1]-[X2]-(linker)-[X3]-[X4]     (Formula 1);

(b) [X1]-[X2]-[linker]-[X4]-[X3]     (Formula 2);

(c) [X2]-[X1]-[linker]-[X3]-[X4]     (Formula 3);

(d) [X2]-[X1]-[linker]-[X4]-[X3]     (Formula 4);

(e) [X3]-[X4]-[linker]-[X1]-[X2]     (Formula 5);

(f) [X3]-[X4]-[linker]-[X2]-[X1]     (Formula 6);

(g) [X4]-[X3]-[linker]-[X1]-[X2]     (Formula 7); or (h) [X4]-[X3]-[linker]-[X2]-[X1]     (Formula 8), wherein:
[X1] is selected from: 2[Φ]-1[+]-2[Φ]-1[ζ]-1[+]-; 2[Φ]-1[+]-2[Φ]-2[+]-; 1[+]-1[Φ]-1[+]-2[Φ]-1[ζ]-1[+]-; and 1[+]-1[Φ]-1[+]-;
[X2] is selected from: -2[Φ]-1[+]-2[Φ]-2[ζ]; -2[Φ]-1[+]-2[ζ]-2[+]-; -2[Φ]-1[+]-2[Φ]-1[+]-1[ζ]-; -2[Φ]-1[+]-2[Φ]-1[ζ]-1[+]-; -2[Φ]-2[+]-1[ζ]-2[+]-; -2[Φ]-2[+]-1[Φ]-2[ζ]-; -2[Φ]-2[+]-1[Φ]-1[+]-1[ζ]-; and -2[Φ]-2[+]-1[Φ]-1[Φ-1[+]-;
[X3] is selected from: -4[+]-A-; -3[+]-G-A-; -3[+]-A-A-; -2[+]-1[Φ]-1[+]-A-; -2[+]-1[Φ]-G-A-; -2[+]-1[Φ]-A-A-; or -2[+]-A-1[+]-A; -2[+]-A-G-A; -2[+]-A-A-A-; -1[Φ]-3[+]-A-; -1[Φ]-2[+]-G-A-; -1[Φ]-2[+]-A-A-; -1[Φ]-1[+]-1[Φ]-1[+]-A; -1[Φ]-1 [+]-1 [ζ]-G-A; -1 [ζ]-1 [+]-1[Φ]-A-A; -1 [Φ]-1 [+]-A-1 [+]-A; -1 [ζ]-1 [+]-A-G-A; -1 [ζ]-1 [+]-A-A-A; -A-1[+]-A-1[+]-A; -A-1[+]-A-G-A; and -A-1[+]-A-A-A;
[X4] is selected from: -1[ζ]-2A-1[+]-A; -1[ζ]-2A-2[+]; -1[+]-2A-1[+]-A; -1[ζ]-2A-1[+]-1[ζ]-A-1[+]; -1[ζ]-A-1[ζ]-A-1[+]; -2[+]-A-2[+]; -2[+]-A-1[+]-A; -2[+]-A-1[+]-1[ζ]-A-1[+]; -2[+]-1[ζ]-A-1[+]; -1[+]-1[ζ]-A-1[+]-A; -1[+]-1[g-A-2[+]; -1[+]-1[ζ]-A-1[+]-1[ζ]-A-1[+]; -1[+]-2[ζ]-A-1[+]; -1[+]-2[ζ]-2[+]; -1[+]-2[ζ]-1[+]-A; -1[+]-2[Φ-1[+]-1[ζ]-A-1[+]; -1[+]-2[Φ-1[ζ]-A-1[+]; -3[ζ]-2[+]; -3[Φ-1[+]-A; -3[Φ-1[+]-1[ζ]-A-1[+]; -1[ζ]-2A-1[+]-A; -1[ζ]-2A-2[+]; -1[ζ]-2A-1[+]-

1[Q-A-1[+]; -2[+]-A-1[+]-A; -2[+]-1[Φ-1[+]-A; -1[+]-1[ζ]-A-1[+]-A; -1[+]-2A-1[+]-1[ζ]-A-1[+]; and -1[[ζ]-A-1[ζ]-A-1[+]; and
[linker] is selected from: —Gn—; —Sn—; —(GnSn)n—; —(GnSn)nGn—; —(GnSn)nSn—; —(GnSn)nGn(GnSn)n—; and -(GnSn)nSn(GnSn)n—;
wherein: [Φ] is an amino acid which is: Leu, Phe, Trp, lie, Met, Tyr, or Val; [+] is an amino acid which is: Lys or Arg; [ζ] is an amino acid which is: Gln, Asn, Thr, or Ser; A is the amino acid Ala; G is the amino acid Gly; S is the amino acid Ser; and n is an integer from i to 20,1 to 19,1 to 18,1 to 17,1 to 16,1 to 15,1 to 14,1 to 13,1 to 12,1 to 1 11 to 10,1 to 9,1 to 8,1 to 7,1 to 6,1 to 5,1 to 1 to 4, or 1 to 3.

In some embodiments, peptide shuttle agents of the present description may comprise or consist of any one of the amino acid sequences of SEQ ID NOs: 104, 105, 107, 108, 110-131, 133-135, 138, 140, 142, 145, 148, 151, 152, 169-242, and 243-10 242. In some embodiments, peptide shuttle agents of the present description may comprise the amino acid sequence motifs of SEQ ID NOs: 158 and/or 159, which were found in each of peptides FSD5, FSD16, FSD18, FSD19, FSD20, FSD22, and FSD23. In some embodiments, peptide shuttle agents of the present description may comprise the amino acid sequence motif of SEQ ID NO: 158 operably linked to the amino acid sequence motif of SEQ ID NO: 159. In some embodiments, peptide shuttle agents of the present description may comprise or consist of a peptide which is at least 50%, 55%, 60%, 65%, 70%, 75%, 80%, 85%, 90%, or 95% identical to the amino acid sequence of any one of SEQ ID NOs: 104,105,107,108,110-131,133-135,138,140,142,145,148,151,152, 169-242, and 243-10 242, or a functional variant of any one of SEQ ID NOs: 104, 105, 107, 108, 110-131, 133-135, 138, 140, 142, 145, 148, 151, 152, 169-242, and 243-10 242. As used herein, a "functional variant" refers to a peptide having polypeptide cargo transduction activity, which differs from the reference peptide by one or more conservative amino acid substitutions. As used herein, a "conservative amino acid substitution" is one in which one amino acid residue is replaced with another amino acid residue having a similar side chain. Families of amino acid residues having similar side chains have been well defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

In some embodiments, peptide shuttle agents of the present description may comprise or consist of the amino acid sequence of any one of SEQ ID NOs: 57-59, 66-72, or 82-102, or a functional variant thereof having at least 65%, 66%, 67%, 68%, 69%, 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to any one of SEQ ID NOs: 57-59, 66-72, or 82-102. In some embodiments, peptide shuttle agents of the present description do not comprise one or more of the amino acid sequences of any one of SEQ ID NOs: 57-59, 66-72, or 82-102.

In some embodiments, shuttle agents of the present description may comprise oligomers (e.g., dimers, trimers, etc.) of peptides described herein. Such oligomers may be constructed by covalently binding the same or different types of shuttle agent monomers (e.g., using disulfide bridges to link cysteine residues introduced into the monomer sequences). In some embodiments, shuttle agents of the present description may comprise an N-terminal and/or a C-terminal cysteine residue.

Histidine-Rich Domains

In some embodiments, peptide shuttle agents of the present description may further comprise one or more histidine-rich domains. In some embodiments, the histidine-rich domain may be a stretch of at least 2, at least 3, at least 4, at least 5, or at least 6 amino acids comprising at least 30%, at least 35%, at least 40%, at least 45%, at least 50%, at least 55%, at least 60%, at least 65%, at least 70%, at least 75%, at least 80%, at least 85%, or at least 90% histidine residues. In some embodiments, the histidine-rich domain may comprise at least 2, at least 3, at least 4 at least 5, at least 6, at least 7, at least 8, or at least 9 consecutive histidine residues. Without being bound by theory, the histidine-rich domain in the shuttle agent may act as a proton sponge in the endosome through protonation of their imidazole groups under acidic conditions of the endosomes, providing another mechanism of endosomal membrane destabilization and thus further facilitating the ability of endosomally-trapped cargos to gain access to the cytosol. In some embodiments, the histidine-rich domain may be located at or towards the N and/or C terminus of the peptide shuttle agent.

Linkers

In some embodiments, peptide shuttle agents of the present description may comprise one or more suitable linkers (e.g., flexible polypeptide linkers). In some embodiments, such linkers may separate two or more amphipathic alpha-helical motifs (e.g., see the shuttle agent FSD18 in FIG. 49D). In some embodiments, linkers can be used to separate two more domains (CPDs, ELDs, or histidine-rich domains) from one another. In some embodiments, linkers may be formed by adding sequences of small hydrophobic amino acids without rotatory potential (such as glycine) and polar serine residues that confer stability and flexibility. Linkers may be soft and allow the domains of the shuttle agents to move. In some embodiments, prolines may be avoided since they can add significant conformational rigidity. In some embodiments, the linkers may be serine/glycine-rich linkers (e.g., GGS, GGSGGGS (SEQ ID NO: 10 243), GGSGGGSGGGS (SEQ ID NO: 10 244), or the like). In some embodiments, the use shuttle agents comprising a suitable linker may be advantageous for delivering an independent polypeptide cargo to suspension cells, rather than to adherent cells. In some embodiments, the linker may comprise or consist of: —Gn—; —Sn—; —(GnSn)n—; —(GnSn)nGn—; —(GnSn)nSn—; -(GnSn)nGn(GnSn)n—; or -(GnSn)nSn(GnSn)n—, wherein G is the amino acid Gly; S is the amino acid Ser; and n is an integer from 1 to 5.

Endosome Leakage Domains (ELDs)

In some aspects, peptide shuttle agents of the present description may comprise an endosome leakage domain (ELD) for facilitating endosome escape and access to the cytoplasmic compartment. As used herein, the expression "endosome leakage domain" refers to a sequence of amino acids which confers the ability of endosomally-trapped macromolecules to gain access to the cytoplasmic compartment. Without being bound by theory, endosome leakage domains are short sequences (often derived from viral or bacterial peptides), which are believed to induce destabilization of the endosomal membrane and liberation of the endosome contents into the cytoplasm. As used herein, the expression "endosomolytic peptide" is intended to refer to this general class of peptides having endosomal membrane-destabilizing properties. Accordingly, in some embodiments, synthetic peptide or polypeptide-based shuttle agents of the present description may comprise an ELD which is an endosomolytic peptide. The activity of such peptides may be assessed for example using the calcein endosome escape assays described in Example 2.

In some embodiments, the ELD may be a peptide that disrupts membranes at acidic pH, such as pH-dependent membrane active peptide (PMAP) or a pH-dependent lytic peptide. For example, the peptides GALA and INF-7 are amphiphilic peptides that form alpha helixes when a drop in pH modifies the charge of the amino acids which they contain. More particularly, without being bound by theory, it is suggested that ELDs such as GALA induce endosomal leakage by forming pores and flip-flop of membrane lipids following conformational change due to a decrease in pH (Kakudo, Chaki et al., 2004, Li, Nicol et al., 2004). In contrast, it is suggested that ELDs such as INF-7 induce endosomal leakage by accumulating in and destabilizing the endosomal membrane (El-Sayed, Futaki et al., 2009). Accordingly, in the course of endosome maturation, the concomitant decline in pH causes a change in the conformation of the peptide and this destabilizes the endosome membrane leading to the liberation of the endosome contents. The same principle is thought to apply to the toxin A of *Pseudomonas* (Varkouhi, Scholte et al., 2011). Following a decline in pH, the conformation of the domain of translocation of the toxin changes, allowing its insertion into the endosome membrane where it forms pores (London 1992, O'Keefe 1992). This eventually favors endosome destabilization and translocation of the complex outside of the endosome. The above described ELDs are encompassed within the ELDs of the present description, as well as other mechanisms of endosome leakage whose mechanisms of action may be less well defined.

In some embodiments, the ELD may be an antimicrobial peptide (AMP) such as a linear cationic alpha-helical antimicrobial peptide (AMP). These peptides play a key role in the innate immune response due to their ability to strongly interact with bacterial membranes. Without being bound by theory, these peptides are thought to assume a disordered state in aqueous solution, but adopt an alpha-helical secondary structure in hydrophobic environments. The latter conformation thought to contribute to their typical concentration-dependent membrane-disrupting properties. When accumulated in endosomes at certain concentrations, some antimicrobial peptides may induce endosomal leakage.

In some embodiments, the ELD may be an antimicrobial peptide (AMP) such as Cecropin-A/Melittin hybrid (CM series) peptide. Such peptides are thought to be among the smallest and most effective AMP-derived peptides with membrane-disrupting ability. Cecropins are a family of antimicrobial peptides with membrane-perturbing abilities against both Gram-positive and Gram-negative bacteria. Cecropin A (CA), the first identified antibacterial peptide, is composed of 37 amino acids with a linear structure. Melittin (M), a peptide of 26 amino acids, is a cell membrane lytic factor found in bee venom. Cecropin-melittin hybrid peptides have been shown to produce short efficient antibiotic peptides without cytotoxicity for eukaryotic cells (i.e., non-hemolytic), a desirable property in any antibacterial agent. These chimeric peptides were constructed from various combinations of the hydrophilic N-terminal domain of Cecropin A with the hydrophobic N-terminal domain of Melittin, and have been tested on bacterial model systems. Two 26-mers, CA(1-13)M(1-13) and CA(1-8) M(1-18) (Boman et al., 1989), have been shown to demonstrate a wider spectrum and improved potency of natural Cecropin A without the cytotoxic effects of melittin.

In an effort to produce shorter CM series peptides, the authors of Andreu et al., 1992 constructed hybrid peptides such as the 26-mer (CA(1-8)M(1-18)), and compared them with a 20-mer (CA(1-8)M(1-12)), a 18-mer (CA(1-8)M(1-10)) and six 15-mers ((CA(1-7)M(1-8), CA(1-7)M(2-9), CA(1-7)M(3-10), CA(1-7)M(4-11), CA(1-7)M(5-12), and CA(1-7)M(6-13)). The 20 and 18-mers maintained similar activity comparatively to CA(1-8)M(1-18). Among the six 15-mers, CA(1-7)M(1-8) showed low antibacterial activity, but the other five showed similar antibiotic potency compared to the 26-mer without hemolytic effect. Accordingly, in some embodiments, synthetic peptide or polypeptide-based shuttle agents of the present description may comprise an ELD which is or is from CM series peptide variants, such as those described above.

In some embodiments, the ELD may be the CM series peptide CM18 composed of residues 1-7 of Cecropin-A (KWKLFKKIGAVLKVLTTG) fused to residues 2-12 of Melittin (YGRKKRRQRRR), [C(1-7)M(2-12)]. When fused to the cell penetrating peptide TAT, CM18 was shown to independently cross the plasma membrane and destabilize the endosomal membrane, allowing some endosomally-trapped cargos to be released to the cytosol (Salomone et al., 2012). However, the use of a CM18-TAT11 peptide fused to a fluorophore (atto-633) in some of the authors' experiments, raises uncertainty as to the contribution of the peptide versus the fluorophore, as the use of fluorophores themselves have been shown to contribute to endosomolysis—e.g., via photochemical disruption of the endosomal membrane (Erazo-Oliveras et al., 2014).

In some embodiments, the ELD may be CM18 having the amino acid sequence of SEQ ID NO: 1, or a variant thereof having at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identity to SEQ ID NO: 1 and having endosomolytic activity.

In some embodiments, the ELD may be a peptide derived from the N terminus of the HA2 subunit of influenza hemagglutinin (HA), which may also cause endosomal membrane destabilization when accumulated in the endosome.

In some embodiments, synthetic peptide or polypeptide-based shuttle agents of the present description may comprise an ELD which is or is from an ELD set forth in Table I, or a variant thereof having endosome escape activity and/or pH-dependent membrane disrupting activity.

TABLE I

Examples of endosome leakage domains

| Name | Amino acid sequence | SEQ ID NO: | Reference(s) |
|---|---|---|---|
| CM18 | KWKLFKKIGAVLKVLTTG | 1 | (Salomone, Cardarelli et al., 2012) |
| Diphtheria toxin T domain (DT) | VGSSLSCINLDWDVIRDKTKTKIESLKEHGPIKNK MSESPNKTVSEEKAKQYLEEFHQTALEHPELSEL KTVIGINPVFAGANYMWAVNVAQVIDSETADNL EKTTAALSILPGIGSVMGIADGAVHHNTEEIVAQSI ALSSLMVAQAIPLVGELVDIGFAAYNFVESIIN LFQVVHNSYNRPAYSPG | 2 | (Uherek, Fominaya et al., 1998, Glover, Ng et al., 2009) |
| GALA | WEAALAEALAEALAEHLAEALAEALEALAA | 3 | (Parente, Nir et al., 1990) (Li, Nicol et al., 2004) |
| PEA | VLAGNPAKHDLDIKPTVISHRLHFPEGGSLAALTA HQACHLPLETFTRHRQPRGWEQLEQCGYPVQRL VALYLAARLSWNQVDQVIRNALASPGSGG DLGEAIREQPEQARLALT | 4 | (Fominaya and Wels 1996) |
| INF-7 | GLFEAIEGFIENGWEGMIDGWYGC | 5 | (El-Sayed, Futaki et al., 2009) |
| LAH4 | KKALLALALHHLAHLALHLALALKKA | 6 | (Kichler, Mason et al., 2006) Kichler et al., 2003 |
| HGP | LLGRRGWEVLKYWWNLLQYWSQEL | 7 | Kwon et al., 2010 |
| H5WYG | GLFHAIAHFIHGGWHGLIHGWYG | 8 | (Midoux, Kichler et al., 1998) |
| HA2 | GLFGAIAGFIENGWEGMIDGWYG | 9 | (Lorieau, Louis et al., 2010) |
| EB1 | LIRLWSHLIHIWFQNRRLKWKKK | 10 | (Amand, Norden et al., 2012) |
| VSVG | KFTIVFPHNQKGNWKNVPSNYHYCP | 11 | (Schuster, Wu et al., 1999) |
| Pseudomonas toxin | EGGSLAALTAHQACHLPLETFTRHRQPRGWEQL EQCGYPVQRLVALYLAARLSWNQVDQVIRNALAS PGSGGDLGEAIREQPEQARLALTLAAAESERFVR QGTGNDEAGAANAD | 12 | (Fominaya, Uherek et al., 1998) |

TABLE I-continued

Examples of endosome leakage domains

| Name | Amino acid sequence | SEQ ID NO: | Reference(s) |
|---|---|---|---|
| Melittin | GIGAVLKVLTTGLPALISWIKRKRQQ | 13 | Tan, Chen et al., 2012) |
| KALA | WEAKLAKALAKALAKHLAKALAKALKACEA | 14 | (Wyman, Nicol et at, 1997) |
| JST-1 | GLFEALLELLESLWELLLEA | 15 | (Gottschalk, Sparrow et al., 1996) |
| C(LLKK)$_3$C | CLLKKLLKKLLKKC | 63 | (Luan et al., 2014) |
| G(LLKK)$_3$G | GLLKKLLKKLLKKG | 64 | (Luan et al., 2014) |

In some embodiments, shuttle agents of the present description may comprise one or more ELD or type of ELD. More particularly, they can comprise at least 2, at least 3, at least 4, at least 5, or more ELDs. In some embodiments, the shuttle agents can comprise between 1 and 10 ELDs, between 1 and 9 ELDs, between 1 and 8 ELDs, between 1 and 7 ELDs, between 1 and 6 ELDs, between 1 and 5 ELDs, between 1 and 4 ELDs, between 1 and 3 ELDs, etc.

In some embodiments, the order or placement of the ELD relative to the other domains (CPD, histidine-rich domains) within the shuttle agents of the present description may be varied provided the shuttling ability of the shuttle agent is retained.

In some embodiments, the ELD may be a variant or fragment of any one those listed in Table I, and having endosomolytic activity. In some embodiments, the ELD may comprise or consist of the amino acid sequence of any one of SEQ ID NOs: 1-15, 63, or 64, or a sequence which is at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identical to any one of SEQ ID NOs: 1-15, 63, or 64, and having endosomolytic activity.

In some embodiments, shuttle agents of the present description do not comprise one or more of the amino acid sequence of any one of SEQ ID NOs: 1-15, 63, or 64.

Cell Penetration Domains (CPDs)

In some aspects, the shuttle agents of the present description may comprise a cell penetration domain (CPD). As used herein, the expression "cell penetration domain" refers to a sequence of amino acids which confers the ability of a macromolecule (e.g., peptide or protein) containing the CPD to be transduced into a cell.

In some embodiments, the CPD may be (or may be from) a cell-penetrating peptide or the protein transduction domain of a cell-penetrating peptide. Cell-penetrating peptides can serve as carriers to successfully deliver a variety of cargos intracellularly (e.g., polynucleotides, polypeptides, small molecule compounds or other macromolecules/compounds that are otherwise membrane-impermeable). Cell-penetrating peptides often include short peptides rich in basic amino acids that, once fused (or otherwise operably linked) to a macromolecule, mediate its internalization inside cells (Shaw, Catchpole et al., 2008). The first cell-penetrating peptide was identified by analyzing the cell penetration ability of the HIV-1 trans-activator of transcription (Tat) protein (Green and Loewenstein 1988, Vives, Brodin et al., 1997). This protein contains a short hydrophilic amino acid sequence, named "TAT", which promotes its insertion within the plasma membrane and the formation of pores. Since this discovery, many other cell-penetrating peptides have been described. In this regard, in some embodiments, the CPD can be a cell-penetrating peptide as listed in Table II, or a variant thereof having cell-penetrating activity.

TABLE II

Examples of cell-penetrating peptides

| Name | Amino acid sequence | SEQ ID NO: | Reference(s) |
|---|---|---|---|
| SP | AAVALLPAVLLALLAP | 16 | (Mahlum, Mandal et al., 2007) |
| TAT | YGRKKRRQRRR | 17 | (Green and Loewenstein 1988, Fawell, Seery et al., 1994, Vives, Brodin et al., 1997) |
| Penetratin (Antennapedia) | RQIKIWFQNRRMKWKK | 18 | (Perez, Joliot et al., 1992) |
| pVEC | LLIILRRRIRKQAHAHSK | 19 | (Elmquist, Lindgren et al., 2001) |
| M918 | MVTVLFRRLRIRRACGPPRVRV | 20 | (El-Andaloussi, Johansson et al., 2007) |
| Pep-1 | KETWWETWWTEWSQPKKKRKV | 21 | (Morris, Depollier et al., 2001) |
| Pep-2 | KETWFETWFTEWSQPKKKRKV | 22 | (Morris, Chaloin et al., 2004) |
| Xentry | LCLRPVG | 23 | (Montrose, Yang et al., 2013) |

TABLE II-continued

Examples of cell-penetrating peptides

| Name | Amino acid sequence | SEQ ID NO: | Reference(s) |
|---|---|---|---|
| Arginine stretch | RRRRRRRR | 24 | (Zhou, Wu et al., 2009) |
| Transportan | WTLNSAGYLLGKINLKALAALAKKIL | 25 | (Hallbrink, Floren et al., 2001) |
| SynB1 | RGGRLSYSRRRFSTSTGR | 26 | (Drin, Cottin et al., 2003) |
| SynB3 | RRLSYSRRRF | 27 | (Drin, Cottin et al., 2003) |
| PTD4 | YARAAARQARA | 65 | (Ho et al, 2001) |

Without being bound by theory, cell-penetrating peptides are thought to interact with the cell plasma membrane before crossing by pinocytosis or endocytosis. In the case of the TAT peptide, its hydrophilic nature and charge are thought to promote its insertion within the plasma membrane and the formation of a pore (Herce and Garcia 2007). Alpha helix motifs within hydrophobic peptides (such as SP) are also thought to form pores within plasma membranes (Veach, Liu et al., 2004).

In some embodiments, shuttle agents of the present description may comprise one or more CPD or type of CPD. More particularly, they may comprise at least 2, at least 3, at least 4, or at least 5 or more CPDs. In some embodiments, the shuttle agents can comprise between 1 and 10 CPDs, between 1 and 6 CPDs, between 1 and 5 CPDs, between 1 and 4 CPDs, between 1 and 3 CPDs, etc.

In some embodiments, the CPD may be TAT having the amino acid sequence of SEQ ID NO: 17, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to SEQ ID NO: 17 and having cell penetrating activity; or Penetratin having the amino acid sequence of SEQ ID NO: 18, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 85%, 86%, 87%, 88%, 89%, 90%, 91%, 92%, 93%, 94%, or 95% identity to SEQ ID NO: 18 and having cell penetrating activity.

In some embodiments, the CPD may be PTD4 having the amino acid sequence of SEQ ID NO: 65, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to SEQ ID NO: 65.

In some embodiments, the order or placement of the CPD relative to the other domains (ELD, histidine-rich domains) within the shuttle agents of the present description may be varied provided the shuttling ability of the shuttle agent is retained.

In some embodiments, the CPD may be a variant or fragment of any one those listed in Table II, and having cell penetrating activity. In some embodiments, the CPD may comprise or consist of the amino acid sequence of any one of SEQ ID NOs: 16-27 or 65, or a sequence which is at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identical to any one of SEQ ID NOs: 16-27 or 65, and having cell penetrating activity.

In some embodiments, shuttle agents of the present description do not comprise any one of the amino acid sequences of SEQ ID NOs: 16-27 or 65.

Cargos

In some aspects, peptide shuttle agents of the present description may be useful for delivering a polypeptide cargo (e.g., an independent polypeptide cargo) from an extracellular space to the cytosol and/or nucleus of a target eukaryotic cell, wherein the synthetic peptide shuttle agent is used at a concentration sufficient to increase the transduction efficiency of said polypeptide cargo, as compared to in the absence of said synthetic peptide shuttle agent. In some embodiments, the polypeptide cargo may be fused to one or more CPDs to further facilitate intracellular delivery. In some embodiments, the CPD fused to the polypeptide cargo may be the same or different from a CPD that may be present in the shuttle agent of the present description. Such fusion proteins may be constructed using standard recombinant technology. In some embodiments, the independent polypeptide cargo may be fused, complexed with, or covalently bound to a second biologically active cargo (e.g., a biologically active polypeptide or compound). Alternatively or simultaneously, the polypeptide cargo may comprise a subcellular targeting domain.

In some embodiments, the polypeptide cargo must be delivered to the nucleus for it to carry out its intended biological effect. One such example is when the cargo is a polypeptide intended for nuclear delivery (e.g., a transcription factor). In this regard, studies on the mechanisms of translocation of viral DNA have led to the identification of nuclear localization signals (NLSs). The NLS sequences are recognized by proteins (importins a and R), which act as transporters and mediators of translocation across the nuclear envelope. NLSs are generally enriched in charged amino acids such as arginine, histidine, and lysine, conferring a positive charge which is partially responsible for their recognition by importins. Accordingly, in some embodiments, the polypeptide cargo may comprise an NLS for facilitating nuclear delivery, such as one or more of the NLSs as listed in Table III, or a variant thereof having nuclear targeting activity. Of course, it is understood that, in certain embodiments, the polypeptide cargo may comprise its natural NLS.

TABLE III

Nuclear localizaion signals

| Name | Amino acid sequence | SEQ ID NO: | Reference(s) |
|---|---|---|---|
| E1a | KRPRP | 28 | (Kohler, Gorlich et al., 2001) |
| SV40 T-Ag | PKKKRKV | 29 | (Lanford, Kanda et al., 1986) |
| c-myc | PAAKRVKLD | 30 | (Makkerh, Dingwall et al., 1996) |
| Op-T-NLS | SSDDEATADSQHAAPPKKKRKV | 31 | (Chan and Jans 1999) |
| Vp3 | KKKRK | 32 | (Nakanishi, Shum et al., 2002) |
| Nucleoplasmin | KRPAATKKAGQAKKKK | 33 | (Fanara, Hodel et al., 2000) |
| Histone 2B NLS | DGKKRKRSRK | 34 | (Moreland, Langevin et al., 1987) |
| Xenopus N1 | VRKKRKTEEESPLKDKDAKKSKQE | 35 | (Kleinschmidt and Seiter 1988) |
| PARP | KRKGDEVDGVDECAKKSKK | 36 | (Schreiber, Molinete et al., 1992) |
| PDX-1 | RRMKWKK | 37 | (Moede, Leibiger et al., 1999) |
| QKI-5 | RVHPYQR | 38 | (Wu, Zhou et al., 1999) |
| HCDA | KRPACTLKPECVQQLLVCSQEAKK | 39 | (Somasekaram, Jarmuz et al., 1999) |
| H2B | GKKRSKA | 40 | (Moreland, Langevin et al., 1987) |
| v-Rel | KAKRQR | 41 | (Gilmore and Temin 1988) |
| Amida | RKRRR | 42 | (Irie, Yamagata et al., 2000) |
| RanBP3 | PPVKRERTS | 43 | (Welch, Franke et al., 1999) |
| Pho4p | PYLNKRKGKP | 44 | (Welch, Franke et al., 1999) |
| LEF-1 | KKKKRKREK | 45 | (Prieve and Waterman 1999) |
| TCF-1 | KKKRRSREK | 46 | (Prieve and Waterman 1999) |
| BDV-P | PRPRKIPR | 47 | (Shoya, Kobayashi et al., 1998) |
| TR2 | KDCVINKHHRNRCQYCRLQR | 48 | (Yu, Lee et al., 1998) |
| SOX9 | PRRRK | 49 | (Sudbeck and Scherer 1997) |
| Max | PQSRKKLR | 50 | (Kato, Lee et al., 1992) |

Once delivered to the cytoplasm, recombinant proteins are exposed to protein trafficking system of eukaryotic cells. Indeed, all proteins are synthetized in the cell's cytoplasm and are then redistributed to their final subcellular localization by a system of transport based on small amino acid sequences recognized by shuttle proteins (Karniely and Pines 2005, Stojanovski, Bohnert et al., 2012). In addition to NMSs, other localization sequences can mediate subcellular targeting to various organelles following intracellular delivery of the polypeptide cargos of the present description. Accordingly, in some embodiments, polypeptide cargos of the present description may comprise a subcellular localization signal for facilitating delivery of the shuttle agent and cargo to specific organelles, such as one or more of the sequences as listed in Table IV, or a variant thereof having corresponding subcellular targeting activity.

TABLE IV

Subcellular localization signals

| Name | Amino acid sequence | SEQ ID NO: | Reference(s) |
|---|---|---|---|
| Mitochondrial signal sequence from Tim9 | NLVERCFTD | 51 | (Milenkovic, Ramming et al., 2009) |
| Mitochondrial signal sequence from Yeast cytochrome c oxidase subunit IV | MLSLRQSIRFFK | 52 | (Hurt, Pesold-Hurt et al., 1985) |
| Mitochondrial signal sequence from 18S rRNA | MLISRCKWSRFPGNQR | 53 | (Bejarano and Gonzalez 1999) |

TABLE IV-continued

Subcellular localization signals

| Name | Amino acid sequence | SEQ ID NO: | Reference(s) |
|---|---|---|---|
| Peroxisome signal sequence-PTS1 | SKL | 54 | (Gould, Keller et al., 1989) |
| Nucleolar signal sequence from BIRC5 | MQRKPTIRRKNLRLRRK | 55 | (Scott, Boisvert et al., 2010) |
| Nucleolar signal sequence from RECQL4 | KQAWKQKWRKK | 56 | (Scott, Boisvert et al., 2010) |

In some embodiments, the cargo can be a biologically active compound such as a biologically active (recombinant) polypeptide (e.g., a transcription factor, a cytokine, or a nuclease) intended for intracellular delivery. As used herein, the expression "biologically active" refers to the ability of a compound to mediate a structural, regulatory, and/or biochemical function when introduced in a target cell.

In some embodiments, the cargo may be a recombinant polypeptide intended for nuclear delivery, such as a transcription factor. In some embodiments, the transcription factor can be HOXB4 (Lu, Feng et al., 2007), NUP98-HOXA9 (Takeda, Goolsby et al., 2006), Oct3/4, Sox2, Sox9, Klf4, c-Myc (Takahashi and Yamanaka 2006), MyoD (Sung, Mun et al., 2013), Pdx1, Ngn3 and MafA (Akinci, Banga et al., 2012), Blimp-1 (Lin, Chou et al., 2013), Eomes, T-bet (Gordon, Chaix et al., 2012), FOXO3A (Warr, Binnewies et al., 2013), NF-YA (Dolfini, Minuzzo et al., 2012), SALL4 (Aguila, Liao et al., 2011), ISL1 (Fonoudi, Yeganeh et al., 2013), FoxA1 (Tan, Xie et al., 2010), Nanog, Esrrb, Lin28 (Buganim et al., 2014), HIF1-alpha (Lord-Dufour et al., 2009), Hlf, Runx1t1, Pbx1, Lmo2, Zfp37, Prdm5 (Riddell et al., 2014), or Bcl-6 (Ichii, Sakamoto et al., 2004).

In some embodiments, the cargo may be a recombinant polypeptide intended for nuclear delivery, such as a nuclease useful for genome editing technologies. In some embodiments, the nuclease may be an RNA-guided endonuclease, a CRISPR endonuclease, a type I CRISPR endonuclease, a type II CRISPR endonuclease, a type III CRISPR endonuclease, a type IV CRISPR endonuclease, a type V CRISPR endonuclease, a type VI CRISPR endonuclease, CRISPR associated protein 9 (Cas9), Cpf1 (Zetsche et al., 2015), CasX and/or CasY (Burstein et al., 2016) a zinc-finger nuclease (ZFN), a Transcription activator-like effector nuclease (TALEN) (Cox et al., 2015), a homing endonuclease, a meganuclease, a DNA-guided nuclease such as Natronobacterium gregoryi Argonaute (NgAgo; Gao et al., 2016), or any combination thereof. In some embodiments, the nuclease may be a catalytically dead endonuclease, such as a catalytically dead CRISPR associated protein 9 (dCas9), dCpf1, dCasX, dCasY, or any combination thereof. Other nucleases not explicitly mentioned here may nevertheless be encompassed in the present description. In some embodiments, the nuclease may be fused to a nuclear localization signal (e.g., Cas9-NLS; Cpf1-NLS; ZFN-NLS; TALEN-NLS). In some embodiments, the nuclease may be complexed with a nucleic acid (e.g., one or more guide RNAs, a crRNA, a tracrRNAs, or both a crRNA and a tracrRNA). In some embodiments, the nuclease may possess DNA or RNA— binding activity, but may lack the ability to cleave DNA.

In some embodiments, the shuttle agents of the present description may be used for intracellular delivery (e.g., nuclear delivery) of one or more CRISPR endonucleases, for example one or more of the CRISPR endonucleases described below.

Type I and its subtypes A, B, C, D, E, F and I, including their respective Cas1, Cas2, Cas3, Cas4, Cas6, Cas7 and Cas8 proteins, and the signature homologs and subunits of these Cas proteins including Cse1, Cse2, Cas7, Cas5, and Cas6e subunits in E. coli (type I-E) and Csy1, Csy2, Csy3, and Cas6f in Pseudomonas aeruginosa (type I-F) (Wiedenheft et al., 2011; Makarova et al, 2011). Type 11 and its subtypes A, B, C, including their respective Cas1, Cas2 and Cas9 proteins, and the signature homologs and subunits of these Cas proteins including Csn complexes (Makarova et al, 2011). Type III and its subtypes A, B and MTH326-like module, including their respective Cas1, Cas2, Cas6 and Cas10 proteins, and the signature homologs and subunits of these Cas proteins including Csm and CMR complexes (Makarova et al, 2011). Type IV represents the Csf3 family of Cas proteins. Members of this family show up near CRISPR repeats in Acidithiobacillus ferrooxidans ATCC 23270, Azoarcus sp. (strain EbNI), and Rhodoferax ferrireducens (strain DSM 15236/ATCC BAA-621/T118). In the latter two species, the CRISPR/Cas locus is found on a plasmid. Type V and it subtypes have only recently been discovered and include Cpf1, C2cl, and C2c3. Type VI includes the enzyme C2c2, which reported shares little homology to known sequences.

In some embodiments, the shuttle agents of the present description may be used in conjunction with one or more of the nucleases, endonucleases, RNA-guided endonuclease, CRISPR endonuclease described above, for a variety of applications, such as those described herein. CRISPR systems interact with their respective nucleic acids, such as DNA binding, RNA binding, helicase, and nuclease motifs (Makarova et al, 2011; Barrangou & Marraffini, 2014). CRISPR systems may be used for different genome editing applications including:

a Cas-mediated genome editing method conducting to non-homologous end-joining (NHEJ) and/or Homologous-directed recombination (HDR) (Cong et al, 2013);

a catalytically dead Cas (dCas) that can repress and/or activate transcription initiation when bound to promoter sequences, to one or several gRNA(s) and to a RNA polymerase with or without a complex formation with others protein partners (Bikard et al, 2013);

a catalytically dead Cas (dCas) that can also be fused to different functional proteins domains as a method to bring enzymatic activities at specific sites of the genome including transcription repression, transcription activation, chromatin remodeling, fluorescent reporter, histone modification, recombinase system acetylation, methylation, ubiquitylation, phosphorylation, sumoylation, ribosylation and citrullination (Gilbert et al, 2013).

The person of ordinary skill in the art will understand that the present shuttle agents, although exemplified with Cas9 and Cpf1 in the present examples, may be used with other nucleases as described herein. Thus, nucleases such as Cpf1, Cas9, and variants of such nucleases or others, are encompassed by the present description. It should be understood that, in one aspect, the present description may broadly cover any cargo having nuclease activity, such an RNA-guided endonuclease, or variants thereof (e.g., those that can bind to DNA or RNA, but have lost their nuclease activity; or those that have been fused to a transcription factor).

In some embodiments, the polypeptide cargo may be a cytokine such as a chemokine, an interferon, an interleukin, a lymphokine, or a tumour necrosis factor. In some embodiments, the polypeptide cargo may be a hormone or growth factor. In some embodiments, the cargo may be an antibody (e.g., a labelled antibody, a therapeutic antibody, an anti-apoptotic antibody, an antibody that recognizes an intracellular antigen). In some embodiments, the cargo may be a detectable label (fluorescent polypeptide or reporter enzyme) that is intended for intracellular delivery, for example, for research and/or diagnostic purposes.

In some embodiments, the cargo may be a globular protein or a fibrous protein. In some embodiments, the cargo may have a molecule weight of any one of about 5, 10, 15, 20, 25, 30, 35, 40, 45, to 50 to about 150, 200, 250, 300, 350, 400, 450, 500 kDa or more. In some embodiments, the cargo may have a molecule weight of between about 20 to 200 kDa.

In some embodiments, the polypeptide cargo may be a peptide cargo, such as peptide that recognizes an intracellular molecule.

In some embodiments, the polypeptide cargo may be an enzyme and/or an enzyme inhibitor.

In some embodiments, peptide shuttle agents of the present description may be useful for delivering a polypeptide cargo from an extracellular space to the cytosol and/or nucleus of different types of target eukaryotic cells, wherein the synthetic peptide shuttle agent is used at a concentration sufficient to increase the transduction efficiency of said polypeptide cargo, as compared to in the absence of said synthetic peptide shuttle agent. The target eukaryotic cells may be an animal cell, a mammalian cell, or a human cell. In some embodiments, the target eukaryotic cells may be a stem cell (e.g., embryonic stem cells, pluripotent stem cells, induced pluripotent stem cells, neural stem cells, mesenchymal stem cells, hematopoietic stem cells, peripheral blood stem cells), a primary cell (e.g., myoblast, fibroblast), or an immune cell (e.g., NK cell, T cell, dendritic cell, antigen presenting cell). It will be understood that cells that are often resistant or not amenable to protein transduction may be interesting candidates for the synthetic peptides or polypeptide-based shuttle agents of the present description.

Non-Toxic, Metabolizable Shuttle Agents

In some embodiments, the shuttle agents of the present description may be non-toxic to the intended target eukaryotic cells at concentrations up to 50 µM, 45 µM, 40 µM, 35 µM, 30 µM, 25 µM, 20 µM, 15 µM, 10 µM, 9 µM, 8 µM, 7 µM, 6 µM, 5 µM, 4 µM, 3 µM, 2 µM, 1 µM, 0.5 µM 0.1 µM, or 0.05 µM. Cellular toxicity of shuttle agents of the present description may be measured using any suitable method. Furthermore, transduction protocols may be adapted (e.g., concentrations of shuttle and/or cargo used, shuttle/cargo exposure times, exposure in the presence or absence of serum), to reduce or minimize toxicity of the shuttle agents, and/or to improve/maximize transfection efficiency.

In some embodiments, shuttle agents of the present description may be readily metabolizable by intended target eukaryotic cells. For example, the shuttle agents may consist entirely or essentially of peptides or polypeptides, for which the target eukaryotic cells possess the cellular machinery to metabolize/degrade. Indeed, the intracellular half-life of the synthetic peptides and polypeptide-based shuttle agents of the present description is expected to be much lower than the half-life of foreign organic compounds such as fluorophores. However, fluorophores can be toxic and must be investigated before they can be safely used clinically (Alford et al., 2009). In some embodiments, shuttle agents of the present description may be suitable for clinical use. In some embodiments, the shuttle agents of the present description may avoid the use of domains or compounds for which toxicity is uncertain or has not been ruled out.

Cocktails

In some embodiments, the present description relates to a composition comprising a cocktail of at least 2, at least 3, at least 4, or at least 5 different types of the synthetic peptides or polypeptide-based shuttle agents as defined herein. In some embodiments, combining different types of synthetic peptides or peptide shuttle agents (e.g., different shuttle agents comprising different types of domains) may provide increased versatility for delivering different polypeptide cargos intracellularly. Furthermore, without being bound by theory, combining lower concentrations of different types of shuttle agents may help reduce cellular toxicity associated with using a single type of shuttle agent (e.g., at higher concentrations).

Methods, Kits, Uses and Cells

In some embodiments, the present description relates to methods for delivering a polypeptide cargo from an extracellular space to the cytosol and/or nucleus of a target eukaryotic cell. The methods comprise contacting the target eukaryotic cell with the polypeptide cargo in the presence of a shuttle agent at a concentration sufficient to increase the transduction efficiency of said polypeptide cargo, as compared to in the absence of said shuttle agent. In some embodiments, contacting the target eukaryotic cell with the polypeptide cargo in the presence of the shuttle agent results in an increase in the transduction efficiency of said polypeptide cargo by at least 10-fold, 20-fold, 30-fold, 40-fold, 50-fold, or 100-fold, as compared to in the absence of said shuttle agent.

In some embodiments, the present description relates to a method for increasing the transduction efficiency of a polypeptide cargo to the cytosol of a target eukaryotic cell. As used herein, the expression "increasing transduction efficiency" refers to the ability of a shuttle agent of the present description to improve the percentage or proportion of a population of target cells into which a cargo of interest (e.g., a polypeptide cargo) is delivered intracellularly across the plasma membrane. Immunofluorescence microscopy, flow cytometry, and other suitable methods may be used to assess cargo transduction efficiency. In some embodiments, a shuttle agent of the present description may enable a transduction efficiency of at least 25%, 30%, 35%, 40%, 45%, 50%, 55%, 60%, 65%, 70%, 75%, 80%, or 85%, for example as measure by immunofluorescence microscopy, flow cytometry, FACS, and other suitable methods. In some embodiments, a shuttle agent of the present description may enable one of the aforementioned transduction efficiencies together wish a cell viability of at least 25%, 30%, 35%, 40%, 45%, 50%, 55%, 60%, 65%, 70%, 75%, 80%, 85%, 90%, or 95%, for example as measure by the assay described in Example 3.3a, or by another suitable assay known in the art.

In addition to increasing target cell transduction efficiency, shuttle agents of the present description may facilitate the delivery of a cargo of interest (e.g., a polypeptide cargo) to the cytosol of target cells. In this regard, efficiently delivering an extracellular cargo to the cytosol of a target cell using peptides can be challenging, as the cargo often becomes trapped in intracellular endosomes after crossing the plasma membrane, which may limit its intracellular availability and may result in its eventual metabolic degradation. For example, use of the protein transduction domain from the HIV-1 Tat protein has been reported to result in massive sequestration of the cargo into intracellular vesicles. In some aspects, shuttle agents of the present description may facilitate the ability of endosomally-trapped cargo to escape from the endosome and gain access to the cytoplasmic compartment. In this regard, the expression "to the cytosol" in the phrase "increasing the transduction efficiency of an independent polypeptide cargo to the cytosol," is intended to refer to the ability of shuttle agents of the present description to allow an intracellularly delivered cargo of interest to escape endosomal entrapment and gain access to the cytoplasmic compartment. After a cargo of interest has gained access to the cytosol, it may be subsequently targeted to various subcellular compartments (e.g., nucleus, nucleolus, mitochondria, peroxisome). In some embodiments, the expression "to the cytosol" is thus intended to encompass not only cytosolic delivery, but also delivery to other subcellular compartments that first require the cargo to gain access to the cytoplasmic compartment.

In some embodiments, the methods of the present description are in vitro methods. In other embodiments, the methods of the present description are in vivo methods.

In some embodiments, the methods of the present description may comprise contacting the target eukaryotic cell with the shuttle agent, or composition as defined herein, and the polypeptide cargo. In some embodiments, the shuttle agent, or composition may be pre-incubated with the polypeptide cargo to form a mixture, prior to exposing the target eukaryotic cell to that mixture. In some embodiments, the type of shuttle agent may be selected based on the amino acid sequence of the polypeptide cargo to be delivered intracellularly. In other embodiments, the type of shuttle agent may be selected to take into account the amino acid sequence of the polypeptide cargo to be delivered intracellularly, the type of cell, the type of tissue, etc.

In some embodiments, the method may comprise multiple treatments of the target cells with the shuttle agent, or composition (e.g., 1, 2, 3, 4 or more times per day, and/or on a pre-determined schedule). In such cases, lower concentrations of the shuttle agent, or composition may be advisable (e.g., for reduced toxicity). In some embodiments, the cells may be suspension cells or adherent cells. In some embodiments, the person of skill in the art will be able to adapt the teachings of the present description using different combinations of shuttles, domains, uses and methods to suit particular needs of delivering a polypeptide cargo to particular cells with a desired viability.

In some embodiments, the methods of the present description may apply to methods of delivering a polypeptide cargo intracellularly to a cell in vivo. Such methods may be accomplished by parenteral administration or direct injection into a tissue, organ, or system.

In some embodiments, the shuttle agent, or composition, and the polypeptide cargo may be exposed to the target cell in the presence or absence of serum. In some embodiments, the method may be suitable for clinical or therapeutic use.

In some embodiments, the present description relates to a kit for delivering a polypeptide cargo from an extracellular space to the cytosol and/or nucleus of a target eukaryotic cell. In some embodiments, the present description relates to a kit for increasing the transduction efficiency of a polypeptide cargo to the cytosol of a target eukaryotic cell. The kit may comprise the shuttle agent, or composition as defined herein, and a suitable container.

In some embodiments, the target eukaryotic cells may be an animal cell, a mammalian cell, or a human cell. In some embodiments, the target eukaryotic cells may be a stem cell (e.g., embryonic stem cells, pluripotent stem cells, induced pluripotent stem cells, neural stem cells, mesenchymal stem cells, hematopoietic stem cells, peripheral blood stem cells), a primary cell (e.g., myoblast, fibroblast), or an immune cell (e.g., NK cell, T cell, dendritic cell, antigen presenting cell). In some embodiments, the present description relates to an isolated cell comprising a synthetic peptide or polypeptide-based shuttle agent as defined herein. In some embodiments, the cell may be a protein-induced pluripotent stem cell. It will be understood that cells that are often resistant or not amenable to protein transduction may be interesting candidates for the synthetic peptides or polypeptide-based shuttle agents of the present description.

In some embodiments, the present description relates to a method for producing a synthetic peptide shuttle agent that delivers a polypeptide cargo from an extracellular space to the cytosol and/or nucleus of a target eukaryotic cell, the method comprising synthesizing a peptide which is:

(1) a peptide at least 20 amino acids in length comprising
(2) an amphipathic alpha-helical motif having
(3) a positively-charged hydrophilic outer face, and a hydrophobic outer face, wherein at least five of the following parameters (4) to (15) are respected:
(4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
(5) the peptide has a hydrophobic moment ($\mu$) of 3.5 to 11;
(6) the peptide has a predicted net charge of at least+4 at physiological pH;
(7) the peptide has an isoelectric point ($\mu$I) of 8 to 13;
(8) the peptide is composed of 35% to 65% of any combination of the amino acids: A, C, G, I, L, M, F, P, W, Y, and V;
(9) the peptide is composed of 0% to 30% of any combination of the amino acids: N, Q, S, and T;
(10) the peptide is composed of 35% to 85% of any combination of the amino acids: A, L, K, or R;
(11) the peptide is composed of 15% to 45% of any combination of the amino acids: A and L, provided there being at least 5% of L in the peptide;
(12) the peptide is composed of 20% to 45% of any combination of the amino acids: K and R;
(13) the peptide is composed of 0% to 10% of any combination of the amino acids: D and E;
(14) the difference between the percentage of A and L residues in the peptide (% A+L), and the percentage of K and R residues in the peptide (% K+R), is less than or equal to 10%; and

(15) the peptide is composed of 10% to 45% of any combination of the amino acids: Q, Y, W, P, I, S, G, V, F, E, D, C, M, N, T, and H.

In some embodiments, the present description relates to a method for identifying a shuttle agent that delivers a polypeptide cargo from an extracellular space to the cytosol and/or nucleus of a target eukaryotic cell, the method comprising: (a) synthesizing a peptide which is the peptide as defined herein; (b) contacting the target eukaryotic cell with the polypeptide cargo in the presence of said peptide; (c) measuring the transduction efficiency of the polypeptide cargo in the target eukaryotic cell; and (d) identifying the peptide as being a shuttle agent that transduces the polypeptide cargo, when an increase in the transduction efficiency of said polypeptide cargo in the target eukaryotic cell is observed.

In some embodiments, the present description relates to a genome editing system comprising: (a) the shuttle agent as defined herein; (b) a CRISPR-associated endonuclease; and (c) one or more guide RNAs. In some embodiments, the genome editing system may further comprise a linear DNA template for controlling the genome editing.

Genome Editing for Improved Cell Therapy

In some embodiments, the shuttle agents, synthetic peptides, compositions, and methods described herein may be used for transducing genome-editing complexes (e.g., the CRISPR-based genome editing complexes) to genetically engineer cells for improved cell therapy, as compared to native cells or unengineered cells. Such improvements may include, for example, reducing the immunogenicity of the engineered cells and/or improving the activity/efficacy of the engineered cells.

Particularly attractive immune cells for genome engineering may be natural killer (NK) cells, given their natural ability to recognize and kill tumor cells. Accordingly, in some embodiments, the present description relates to the use of the shuttle agents, synthetic peptides, compositions, and methods described herein for transducing genome-editing complexes (e.g., the CRISPR-based genome editing complexes) to genetically engineer NK (or other immune cells that would benefit from the same modifications) for improved cell-based immunotherapy. For example, the present description may relate to the intracellular delivery of one or more CRISPR-based genome editing complexes that comprise a guide RNA and/or linear DNA template targeting the CBLB gene, c-CBL gene, GSK3 gene, ILT2 gene, CISH gene, NKG2a gene, B2M gene, or any combination thereof. Such gene targets may potentiate NK-mediated cellular cytotoxicity following knockout, as discussed below.

1. NKG2A (KLRC1, CD159A, Killer Cell Lectin-Like Receptor C1)

CD94/NKG2A acts as an MHC class-I specific NK inhibitory receptor (Braud et al., 1998; Lee et al., 1998). It is expressed by a subset of NK cells known as $CD56^{bright}$ $CD16^{dim}$(10% of peripheral NK), which are typically less cytotoxic (Cooper et al., 2001; Poli et al., 2009). NKG2A ligands are the non-classical MHC class-I HLA-E molecules that are expressed in every human cell. The recognition of HLA-E by the NKG2A receptor is part of the "self-tolerance" mechanism (also including KIR receptors), resulting in negative modulation of NK cell cytotoxicity (Lee et al., 1998).

There exists clinical evidence demonstrating the role of non-classical HLA class I, mainly HLA-E and HLA-G (see ILT-2 target), in evading immune surveillance resulting in higher cancer relapses and decrease overall survival following surgery (de Kruijf et al., 2010; Levy et al., 2008; Ye et al., 2007a; Yie et al., 2007b; Yie et al., 2007c; Yie et al., 2007d; Guo et al., 2015; Ishigami et al., 2015; Zhen et al., 2013). The use of NKG2A-KO NK cells during adoptive cell therapy may counteract the presence of HLA-E molecules (membrane-bound or solubles) in tumor microenvironment. In addition, NK cells expanded from IL15 or IL21-expressing K562 feeder cells lead to a high percentage of $NKG2A^{pos}$ cells (Denman et al., 2012), and it may be desirable to knockout this inhibitory receptor during the expansion process. Furthermore, the results in Example G.9 demonstrate that NKG2A-KO NK92 cells are significantly more cytotoxic against IFN-gamma-treated HeLa cells.

2. ILT2 (Ig-Like transcript 2 gene)

ILT2 is an inhibitory receptor expressed on several immune cells, including NK cells (Kirwan et al., 2005). The ligands for this receptor are HLA-G molecules, which are naturally expressed only in thymus and trophoblasts. However, many tumors gain the capacity to express HLA-G to escape immune cell attack by inhibition through ILT2 receptor activation. In fact, $NKL^{ILT2}$-cells are more potent than parental NKL against HLA-G-overexpressing K562 cells (Wu et al., 2015). Moreover, overexpression of HLA-G in OVCAR-3 cancer cells impaired NK cell-mediated cytotoxicity (Lin et al., 2007). As for HLA-E, expression of HLA-G on cancer cells is generally associated with poor prognosis.

3. c-Cbl and Cbl-b (Casitas B-lineage lymphoma proto-oncogene family).

These genes (from the Casitas B-lineage lymphoma proto-oncogene, Cbl family) encode for E3 ligases, which are function in the protein ubiquitylation pathway (regulation of cellular protein content). E3 ligases catalyze the formation of a covalent bond between Ub (ubiquitin) and specific lysine residues on targeted proteins (more than thousand E3 ligases in mammalians). Cbl family members are involved in negative regulation of signaling by receptor tyrosine kinases on immune cells by binding and ubiquitylating phosphorylated receptor and adaptors (Liu et al., 2014; utz-Nicoladoni, 2015). One demonstrated that both c-cbl and Cbl-b ubiquitylate phosphorylated LAT adaptor. Phosphorylation of LAT following NK cell activation is required to recruit other mediators, especially PLC-<<<and siRNA-mediated c-cbl and Cbl-b knockdown increased NK cell activity against B cell lymphoma 721.221-Cw4 (Matalon et al., 2016).

Others identified TAM (Tyro3, Axl, Mer) receptors as targets for Cbl-b ubiquitylation (Paolino et al., 2014). However, assuming that TAM receptors are proposed to negatively regulate NK cells, Cbl-b knockout should rather be associated to a decrease in NK cell activity. Therefore, TAM receptors may be considered as a good target to enhance NK cells but unlikely via Cbl-b knockout.

In vivo studies demonstrated that $Cbl-b^{-/-}$ mice prevent primary tumor growth (Loeser et al., 2007). In addition, NK cells isolated from these mice have increased proliferation and IFN-production when activated (Paolino et al., 2014).

4. GSK3B (Glycogen Synthase Kinase Beta)

GSK3b is a Ser/Thr kinase involved in several cellular functions, such as proliferation, apoptosis, inflammatory response, stress, and others (Patel et al., 2017). Inhibition of GSK3b (using small inhibitors) in NK cells leads to increase cytotoxicity (likely through IFN-g, TNF-<production, 2B4 stimulation and up-regulation of LFA-1) against AML (OCI-AML3) (Parameswaran et al., 2016; Aoukaty et al., 2005). We have recently demonstrated that the GSK3<inhibitor, SB216763, enhances the cytotoxic activity of NK92 against HeLa cells (data not shown). This effect is increased by co-incubation with IL-15.

5. CISH (Cytokine-inducible SH2-containing protein)

CIS protein is a member of the suppressor of cytokine signaling (SOCS) proteins, which bind to phosphorylated JAKs and inhibit JAK-STAT signaling pathways. Recently, Cish$^{-/-}$ mice demonstrated that CIS is a key suppressor of IL15 signaling in NK cells (Delconte et al., 2016). Following IL15 exposure, these cells have prolonged IL15 responses, an elevated IFN-g production, and an increased cytotoxic potential. Moreover, there is a clear relationship between IL15 responsiveness and NKG2D-dependent cytotoxicity (Horng et al., 2007).

In clinical trials, co-injection of cytokines, such as IL2 and IL15, during adoptive NK-cell therapy is strongly recommended to sustain NK cell activity. However, such a co-injection induces serious side effects to patients. The use of IL15-hypersensitive NK cells (CISH knockout) would benefit the treatment.

In some embodiments, disrupting the B2M gene encoding 32 microglobulin (B2M), a component of MHC class I molecules, may substantially reduce the immunogenicity of every cell expressing MHC class 1. In other aspects, the genome of NK cells can be modified after the delivery of a genome editing system as described herein. More specifically, the cytotoxicity of NK cells can be improved after the delivery of a genome editing system targeting specific putative targets that may potentiate NK-mediated cellular cytotoxicity such as the NKG2A, ILT2, c-Cbl, Cbl-b, GSK3B and CISH genes.

Co-Transduction with a Polypeptide Cargo of Interest and a Marker Protein

The ability of domain-based and rationally-designed peptide shuttle agents to co-transduce two different polypeptide cargos into a population of target eukaryotic cells has been demonstrated herein and in PCT patent application publication No. WO/2016/161516. Example I of the present description shows that co-transducing a polypeptide cargo of interest (e.g., a CRISPR-endonuclease) and an independent marker protein (e.g., GFP) in a population of target eukaryotic cells may not necessarily increase the overall transduction efficiency of the polypeptide cargo of interest. However, it was surprisingly discovered that a strikingly high proportion of target eukaryotic cells that were successfully transduced with the polypeptide cargo of interest, were also successfully transduced with the marker protein. Conversely, a strikingly high proportion of cells that were not transduced with the polypeptide cargo of interest, were also not transduced with the marker protein. Isolating cells positive for the marker protein (e.g., via FACS) resulted in a significant increase in the proportion of cells that were successfully transduced with the polypeptide cargo of interest, and the correlation was found to be concentration dependent in that cell populations exhibiting the highest fluorescence of the marker protein also exhibited the highest proportion of transduction with the polypeptide cargo of interest.

In some aspects, the present description relates to a method for enriching eukaryotic cells transduced with a polypeptide cargo of interest. The method may comprise (a) co-transducing a target eukaryotic cell population with a polypeptide cargo of interest and a marker protein; and (b) isolating or concentrating eukaryotic cells transduced with the marker protein, thereby enriching eukaryotic cells transduced with the polypeptide cargo of interest.

In some embodiments, the marker protein may not be covalently bound to the polypeptide cargo of interest (e.g., the marker protein is independent from the polypeptide cargo of interest), the marker protein may be covalently bound to the polypeptide cargo of interest, the marker protein may be non-covalently bound to the polypeptide cargo of interest (e.g., electrostatically and/or conformationally bound via a protein domain-protein domain interaction), or the marker protein is covalently bound to the polypeptide cargo of interest via a cleavable linker (e.g., a linker peptide comprising an enzyme cleavage site, such as an enzyme expressed in endosomes, lysosomes, or in the cytosol). In some embodiments, the intracellular concentration of the transduced marker protein may be positively correlated with the intracellular concentration of the transduced polypeptide cargo of interest.

In some embodiments, the marker protein may comprise a detectable label. As used herein, "detectable label" refers to a molecule or particle that enables a person of skill in the art to identify and separate cells comprising the label from cells lacking the label. In some embodiments, the marker protein may be a fluorescent protein, a fluorescently-labeled protein, a bioluminescent protein, an isotopically-labelled protein, a magnetically-labeled protein, or another detectable label that enables separation of cells containing the marker protein from cells lacking the marker protein, or enables separation of cells based on the level of intracellular marker protein.

In some embodiments, eukaryotic cells transduced with the marker protein may be isolated or concentrated using flow cytometry, fluorescence-activated cell sorting (FACS), magnetic-activated cell sorting (MACS), or other known cell separation/sorting technologies. Isolating or enriching successfully transduced cells may be particularly advantageous, for example, for polypeptide cargoes such as functional CRISPR-based genome-editing complexes, which may be associated with relatively lower transduction efficiencies.

It was also surprisingly disclosed herein in Example I that cells that were unsuccessfully transduced following a first round of transduction with a polypeptide cargo of interest, may be isolated and re-transduced with the polypeptide cargo of interest in subsequent rounds of transduction. These results suggest that, although the cells unsuccessfully transduced following a first round of transduction with a polypeptide cargo of interest are not necessarily refractory to subsequent transductions.

In some embodiments, the present description relates to a method for enriching eukaryotic cells transduced with a polypeptide cargo of interest, the method comprising: (a) co-transducing a target eukaryotic cell population with a polypeptide cargo of interest and a marker protein; (b) isolating eukaryotic cells transduced with the marker protein from cells lacking the marker protein, thereby producing a marker protein-positive cell population and a marker protein-negative cell population. In some embodiments, steps (a) and (b) may be repeated, one or more times, on the marker protein-negative cell population, on the marker protein-positive cell population, or on both the marker protein-negative and the marker protein-positive cell populations. In some embodiments, the method for enriching eukaryotic cells transduced with a polypeptide cargo of interest may be automated, for example, by isolating cells negative for transduction with the marker protein and re-transducing the marker protein-negative cell population.

In some embodiments, the present description relates to a method for enriching eukaryotic cells transduced with a polypeptide cargo of interest, the method comprising: (a) co-transducing a target eukaryotic cell population with a polypeptide cargo of interest and a marker protein; and (b)

isolating eukaryotic cells transduced with the marker protein based on their intracellular concentration of the marker protein.

In some embodiments, the marker protein described herein may be a protein that stimulates cell proliferation (e.g., a growth factor or a transcription factor), a protein that stimulates cell differentiation, a protein that promotes cell survival, an anti-apoptotic protein, or a protein having another biological activity.

In some embodiments, the polypeptide cargo of interest and the marker protein may be co-transduced by contacting the target eukaryotic cell with the polypeptide cargo and the marker protein in the presence of a peptide transduction agent, wherein the peptide transduction agent is present at a concentration sufficient to increase the transduction efficiency of the polypeptide cargo and the marker protein, as compared to in the absence of said peptide transduction agent. In some embodiments, the peptide transduction agent may be an endosomolytic peptide. In some embodiments, the peptide transduction agent is or comprises a domain-based peptide shuttle agent, or a rationally designed peptide shuttle agent as defined herein, in PCT patent application publication No. WO/2016/161516, and/or U.S. Pat. No. 9,738,687. In some embodiments, the aforementioned domain-based peptide shuttle agent may be a synthetic peptide comprising an endosome leakage domain (ELD) operably linked to a cell penetrating domain (CPD), or an ELD operably linked to a histidine-rich domain and a CPD. In some embodiment, the aforementioned domain-based peptide shuttle agent: (a) comprises a minimum length of 20, 21, 22, 23, 24, 25, 26, 27, 28, 29, or 30 amino acid residues and a maximum length of 35, 40, 45, 50, 55, 65, 70, 75, 80, 85, 90, 95, 100, 105, 110, 115, 120, 125, 130, 135, 140, 145, or 150 amino acid residues; (b) has a predicted net charge of at least+4, +5, +6, +7, +8, +9, +10, +11, +12, +13, +14, or +15 at physiological pH; (c) is soluble in aqueous solution; or (d) any combination of (a) to (c). In some embodiments, the ELD, CPD, histidine-rich domain, linker domain, are as defined herein. In some embodiments, the target eukaryotic cells comprise or consist of animal cells, mammalian cells, human cells, stem cells, primary cells, immune cells, T cells, NK cells, dendritic cells, or other types or sub-types of cells.

In some embodiments, the polypeptide cargo of interest may be: (i) the polypeptide cargo as defined herein; and/or (ii) one or more CRISPR-associated endonucleases alone or with one or more corresponding guide RNA and/or linear DNA templates as defined herein.

Items

In some embodiments, the present description may relate to the following items:

1. A method for delivering a polypeptide cargo from an extracellular space to the cytosol and/or nucleus of a target eukaryotic cell, said method comprising contacting the target eukaryotic cell with the polypeptide cargo in the presence of a shuttle agent at a concentration sufficient to increase the transduction efficiency of said polypeptide cargo, as compared to in the absence of said shuttle agent, wherein said shuttle agent is
   (1) a peptide at least 20 amino acids in length comprising
   (2) an amphipathic alpha-helical motif having
   (3) a positively-charged hydrophilic outer face, and a hydrophobic outer face, wherein at least five of the following parameters (4) to (15) are respected:
   (4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
   (5) the peptide has a hydrophobic moment ($\mu$) of 3.5 to 11;
   (6) the peptide has a predicted net charge of at least+4 at physiological pH;
   (7) the peptide has an isoelectric point ($\mu$l) of 8 to 13;
   (8) the peptide is composed of 35% to 65% of any combination of the amino acids: A, C, G, I, L, M, F, P, W, Y, and V;
   (9) the peptide is composed of 0% to 30% of any combination of the amino acids: N, Q, S, and T;
   (10) the peptide is composed of 35% to 85% of any combination of the amino acids: A, L, K, or R;
   (11) the peptide is composed of 15% to 45% of any combination of the amino acids: A and L, provided there being at least 5% of L in the peptide;
   (12) the peptide is composed of 20% to 45% of any combination of the amino acids: K and R;
   (13) the peptide is composed of 0% to 10% of any combination of the amino acids: D and E;
   (14) the difference between the percentage of A and L residues in the peptide (% A+L), and the percentage of K and R residues in the peptide (K+R), is less than or equal to 10%; and
   (15) the peptide is composed of 10% to 45% of any combination of the amino acids: Q, Y, W, P, I, S, G, V, F, E, D, C, M, N, T and H.

2. The method of item 1, wherein the shuttle agent respects at least six, at least seven, at least eight, at least nine, at least ten, at least eleven, or respects all of parameters (4) to (15).

3. The method of item 1 or 2, wherein:
   (i) said shuttle agent is a peptide having a minimum length of 20, 21, 22, 23, 24, 25, 26, 27, 28, 29, or 30 amino acids, and a maximum length of 40, 41, 42, 43, 44, 45, 46, 47, 48, 49, 50, 51, 52, 53, 54, 55, 60, 65, 70, 80, 90, 100, 110, 120, 130, 140, or 150 amino acids;
   (ii) said amphipathic alpha-helical motif has a hydrophobic moment ($\mu$) between a lower limit of 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9,10.0, 10.1,10.2, 10.3,10.4, 10.5,10.6, 10.7,10.8, 10.9, or 11.0;
   (iii) said amphipathic alpha-helical motif comprises a positively-charged hydrophilic outer face comprising: (a) at least two, three, or four adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn;
   (iv) said amphipathic alpha-helical motif comprises a hydrophobic outer face comprising: (a) at least two adjacent L residues upon helical wheel projection; and/or (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn;

(v) said hydrophobic outer face comprises a highly hydrophobic core consisting of spatially adjacent L, I, F, V, W, and/or M amino acids representing from 12.5%, 13%, 13.5%, 14%, 14.5%, 15%, 15.5%, 16%, 16.5%, 17%, 17.5%, 18%, 18.5%, 19%, 19.5%, or 20%, to 25%, 30%, 35%,40%, or 45% of the amino acids of the peptide;

(vi) said peptide has a hydrophobic moment (μ) between a lower limit of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9,10.0, 10.1, 10.2,10.3,10.4, or 10.5;

(vii) said peptide has a predicted net charge of between +4, +5, +6, +7, +8, +9, to +10, +11, +12, +13, +14, or +15;

(viii) said peptide has a predicted pI of 10-13; or (ix) any combination of (i) to (viii).

4. The method of any one of items 1 to 3, wherein said shuttle agent respects at least one, at least two, at least three, at least four, at least five, at least six, or all of the following parameters:

(8) the peptide is composed of 36% to 64%, 37% to 63%, 38% to 62%, 39% to 61%, or 40% to 60% of any combination of the amino acids: A, C, G, I, L, M, F, P, W, Y, and V;

(9) the peptide is composed of 1% to 29%, 2% to 28%, 3% to 27%, 4% to 26%, 5% to 25%, 6% to 24%, 7% to 23%, 8% to 22%, 9% to 21%, or 10% to 20% of any combination of the amino acids: N, Q, S, and T;

(10) the peptide is composed of 36% to 80%, 37% to 75%, 38% to 70%, 39% to 65%, or 40% to 60% of any combination of the amino acids: A, L, K, or R;

(11) the peptide is composed of 15% to 40%, 20% to 40%, 20 to 35%, or 20 to 30% of any combination of the amino acids: A and L;

(12) the peptide is composed of 20% to 40%, 20 to 35%, or 20 to 30% of any combination of the amino acids: K and R;

(13) the peptide is composed of 5 to 10% of any combination of the amino acids: D and E;

(14) the difference between the percentage of A and L residues in the peptide (% A+L), and the percentage of K and R residues in the peptide (K+R), is less than or equal to 9%, 8%, 7%, 6%, or 5%; and

(15) the peptide is composed of 15 to 40%, 20% to 35%, or 20% to 30% of any combination of the amino acids: Q, Y, W, P, I, S, G, V, F, E, D, C, M, N, T, and H.

5. The method of any one of items 1 to 4, wherein said peptide comprises a histidine-rich domain.

6. The method of item 5, wherein said histidine-rich domain is:

(i) positioned towards the N terminus and/or towards the C terminus of the peptide;

(ii) is a stretch of at least 3, at least 4, at least 5, or at least 6 amino acids comprising at least 50%, at least 55%, at least 60%, at least 65%, at least 70%, at least 75%, at least 80%, at least 85%, or at least 90% histidine residues; and/or comprises at least 2, at least 3, at least 4, at least 5, at least 6, at least 7, at least 8, or at least 9 consecutive histidine residues; or (iii) both (i) and (ii).

7. The method of any one of items 1 to 6, wherein said peptide comprises a flexible linker domain rich in serine and/or glycine residues.

8. The method of any one of items 1 to 7, wherein said peptide comprises or consists of the amino acid sequence of: (a) [X1]–[X2]–[linker]–[X3]–[X4](Formula 1); (b) [X1]–[X2]–[linker]–[X4]–[X3](Formula 2); (c) [X2]–[X1]–[linker]–[X3]–[X4](Formula 3); (d) [X2]–[X1]–[linker]–[X4]–[X3](Formula 4); (e) [X3]–[X4]–[linker]–[X1]–[X2](Formula 5); (f) [X3]–[X4]–[linker]–[X2]–[X1](Formula 6); (g) [X4]–[X3]–[linker]–[X1]–[X2](Formula 7); or (h) [X4]–[X3]–[linker]–[X2]–[X1](Formula 8), wherein: [X1]is selected from: 2[Φ]–1[+]–2[Φ]–1[–1[+]–; 2[Φ]–1[+]–2[Φ]–2[+]–; 1[+]–1[Φ]–1[+]–2[Φ]–1[Φ–1[+]–; and 1[+]–1[Φ]–1[+]–2[(V)–2[+]–; [X2]is selected from: –2[Φ]–1[+]–2[Φ]–2[ζ]–; –2[(D)–1[+]–2[Φ]–2[+]–; –2[(t)–1[+]–2[q)]–1[+]–1[ζ]–; –2[Φ]–1[+]–2[Φ]–1[Φ–1[+]–; –2[ζ]–2[+]–1[Φ]–2[+]–; –2[qI]–2[+]–1[Φ]–2[ζ]–; –2[c]–2[+]–1[1]–1[+]–1[Φ]–; and –2[Φ]–2[+]–1[–]–1[Φ–1[+]–; [X3]is selected from: –4[+]–A–; –3[+]–G–A–; –3[+]–A–A–; –2[+]–1[Φ]–1[+]–A–; –2[+]–1[Φ]–G–A–; –2[+]–1[Φ]–A–A–; or –2[+]–A–1[+]–A; –2[+]–A–G–A; –2[+]–A–A–A–; –1[Φ]–3[+]–A–; –1[Φ]–2[+]–G–A–; –1[Φ]–2[+]–A–A–;–1[Φ]–1[+]–1[Φ]–1[+]–A–1[Φ]–1[+]–1[Φ]–G–A;–1[Φ]–i[+]–1[Φ]–A–A; –1[(I]–1[+]–A–1[+]–A; –1[Φ]–1[+]–A–G–A; –1[Φ]–1[+]–A–A–A; –A–1[+]–A–1[+]–A; –A–1[+]–A–G–A; and –A–1[+]–A–A–A; [X4]is selected from: –1[ζ]–2A–1[+]–A; –1[Q–2A–2[+]; –1[+]–2A–1[+]–A; –1[ζ]–2A–1[+]–1[ζ]–A–1[+]; –1[(–A–1[ζ]–A–1[+]; –2[+]–A–2[+]; –2[+]–A–1[+]–A; –2[+]–A–1[+]–1[[ζ]–A–1[+]; –2[+]–1[–A–1 [+]; –1 [+]–1 [ζ]–A–1 [+]–A; –1 [+]–1 [f–A–2[+]; –1 [+]–1 [i;–A–1 [+]–1 [ζ]–A–1 [+]; –1 [+]–2 [Φ]–A–1 [+]; –1 [+]–2[Φ]–2[+]; –1[Φ]2-1 [+]–A; –1 [+]–2[Qj-1 [+]–1 [–A–1 [+]; –1[+]–2[Φ–1[ζ]–A–1 [+]; –3[ζ]–2[+]; –3[ζ]–1[+]–A; –3[ζ]–1[+]–1[ζ]–A–1[+]; –1[ζ]–2A–1[+]–A; –1[ζ]–2A–2[+]; –1[ζ]–2A–1 [+]–1[ζ]–A–1[+]; –2[+]–A–1[+]–A; –2[+]–1[ζ]–1[+]–A; –1[+]–1[ζ]–A–1[+]–A; –1[+]–2A–1[+]–1[ζ]–A–1[+]; and –1[ζ]–A–1[(–A–1[+]; and [linker]is selected from: —Gn—; —Sn—; —(GnSn)n—; —(GnSn)nGn—; —(GnSn)nSn—; —(GnSn)nGn(GnSn)n—; and -(GnSn)nSn(GnSn)n—; wherein: [Φ]is an amino acid which is: Leu, Phe, Trp, IIe, Met, Tyr, or Val; [+]is an amino acid which is: Lys or Arg; [Φ]is an amino acid which is: Gln, Asn, Thr, or Ser; A is the amino acid Ala; G is the amino acid Gly; S is the amino acid Ser; and n is an integer from 1 to 20,1 to 19,1 to 18,1 to 17,1 to 16,1 to 15,1 to 14,1 to 13,1 to 12,1 to 11, 1 to 10, 1 to 9, 1 to 8, 1 to 7, 1 to 6, 1 to 5, 1 to 1 to 4, or 1 to 3.

9. The method of any one of items 1 to 8, wherein:

(i) said peptide is at least 50%, 55%, 60%, 65%, 70%, 75%, 80%, 85%, 90%, or 95% identical to the amino acid sequence of any one of SEQ ID NOs: 104, 105, 107, 108, 110-131, 133-135, 138, 140, 142, 145, 148, 151, 152, 169-242, and 243-10242; or said peptide comprises or consists of a functional variant of any one of SEQ ID NOs: 104, 105,107, 108, 110-131, 133-135, 138,140, 142,145,148,151,152,169-242, and 243-10 242;

(ii) said peptide:

(a) comprises or consists of the amino acid sequence of any one of SEQ ID NOs: 104,105,107,108,110-131,133-135,138,140,142,145,148,151,152,169-242, and 243-10 242;

(b) comprises the amino acid sequence motifs of SEQ ID NOs: 158 and/or 159; or (c) comprises the amino acid sequence motif of SEQ ID NO: 158 operably linked to the amino acid sequence motif of SEQ ID NO: 159; or
(iii) both (i) and (ii).
10. The method of any one of items 1 to 9, wherein the peptide comprises an endosome leakage domain (ELD), and/or a cell penetrating domain (CPD).
11. The method of item 10, wherein:
(i) said ELD is or is from: an endosomolytic peptide; an antimicrobial peptide (AMP); a linear cationic alpha-helical antimicrobial peptide; a Cecropin-A/Melittin hybrid (CM series) peptide; pH-dependent membrane active peptide (PAMP); a peptide amphiphile; a peptide derived from the N terminus of the HA2 subunit of influenza hemagglutinin (HA); CM18; Diphtheria toxin T domain (DT); GALA; PEA; INF-7; LAH4; HGP; H5WYG; HA2; EB1; VSVG; *Pseudomonas* toxin; melittin; KALA; JST-1; C(LLKK)$_3$C; G(LLKK)$_3$G; or any combination thereof;
(ii) said CPD is or is from: a cell-penetrating peptide or the protein transduction domain from a cell-penetrating peptide; TAT; PTD4; Penetratin (Antennapedia); pVEC; M918; Pep-1; Pep-2; Xentry; arginine stretch; transportan; SynB1; SynB3; or any combination thereof; or
(iii) both (i) and (ii).
12. The method of item 10 or 11, wherein said peptide comprises:
(a) an ELD comprising the amino acid sequence of any one of SEQ ID NOs: 1-15, 63, or 64, or a variant or fragment thereof having endosomolytic activity;
(b) a CPD comprising the amino acid sequence of any one of SEQ ID NOs: 16-27 or 65, or a variant or fragment thereof having cell penetrating activity; or
(c) both (a) and (b).
13. The method of any one of items 10 to 12, wherein:
(i) said peptide comprises an ELD which is CM18, KALA, or C(LLKK)3C having the amino acid sequence of SEQ ID NO: 1,14, or 63, or a variant thereof having at least 50%, 55%, 60%, 65%, 70%, 75%, 80%, 85%, 90%, or 95% identity to SEQ ID NO: 1,14, or 63, and having endosomolytic activity;
(ii) wherein said peptide comprises a CPD which is TAT or PTD4 having the amino acid sequence of SEQ ID NO: 17 or 65, or a variant thereof having at least 50%, 55%, 60%, 65%, 70%, 75%, 80%, 85%, 90%, or 95% identity to SEQ ID NO: 17 or 65 and having cell penetrating activity; or
(iii) both (i) and (ii).
14. The method of any one of items 1 to 9, wherein said peptide comprises the amino acid sequence of any one of SEQ ID NOs: 57-59, 66-72, or 82-102, or a functional variant thereof having at least 85%, 90%, or 95% identity to any one of SEQ ID NOs: 57-59, 66-72, or 82-102.
15. The method of any one of items 1 to 14, wherein:
(i) said shuttle agent is completely metabolizable by the target eukaryotic cell; and/or
(ii) contacting the target eukaryotic cell with the polypeptide cargo in the presence of the shuttle agent at said concentration results in an increase in the transduction efficiency of said polypeptide cargo by at least 10-fold, 20-fold, 30-fold, 40-fold, 50-fold, or 100-fold, as compared to in the absence of said shuttle agent.
16. The method of any one of items 1 to 15, which is an in vitro method.
17. A synthetic peptide shuttle agent which is the peptide as defined in any one of items 1 to 15.
18. The synthetic peptide of item 17, which is a peptide between 20 and 100 amino acids in length comprising the amino acid sequence of any one of SEQ ID NOs: 104, 15 0,18 1,11 1,13 1,15 1,17 1,19 2,11 122,123, 124,125, 126,127, 128, 129, 130, 131, 133, 134, 135, 138, 140, 142, 145, 148, 151, 152, 169-242, and 243-10 242; or comprises the amino acid sequence motifs of SEQ ID NOs: 158 and/or 159.
19. The synthetic peptide shuttle agent of item 17 or 18 for use in delivering a polypeptide cargo from an extracellular space to the cytosol and/or nucleus of a target eukaryotic cell in vitro, wherein the synthetic peptide shuttle agent is used at a concentration sufficient to increase the transduction efficiency of said polypeptide cargo, as compared to in the absence of said synthetic peptide shuttle agent..
20. The synthetic peptide shuttle agent of item 17 or 18 for use in delivering a polypeptide cargo from an extracellular space to the cytosol and/or nucleus of a target eukaryotic cell in vivo, wherein the synthetic peptide shuttle agent is used at a concentration sufficient to increase the transduction efficiency of said polypeptide cargo, as compared to in the absence of said synthetic peptide shuttle agent.
21. A composition comprising the shuttle agent as defined in any one of items 1 to 15, or a cocktail of at least 2, at least 3, at least 4, or at least 5 different types of the shuttle agents as defined in any one of items 1 to 15, and a polypeptide cargo to be delivered from an extracellular space to the cytosol and/or nucleus of a target eukaryotic cell.
22. Use of the shuttle agent as defined in any one of items 1 to 15, or the synthetic peptide as defined in item 18, for delivering a polypeptide cargo from an extracellular space to the cytosol and/or nucleus of a target eukaryotic cell, wherein the shuttle agent or synthetic peptide is used at a concentration sufficient to increase the transduction efficiency of said polypeptide cargo, as compared to in the absence of said shuttle agent or synthetic peptide.
23. A kit for delivering a polypeptide cargo from an extracellular space to the cytosol and/or nucleus of a target eukaryotic cell, said kit comprising the shuttle agent as defined in any one of items 1 to 15, or the synthetic peptide as defined in item 18, and a suitable container.
24. The method of any one of items 1 to 16, the synthetic peptide shuttle agent of any one of items 17 to 20, the composition of item 21, the use of item 22, or the kit of item 23, wherein said polypeptide cargo lacks a cell penetrating domain.
25. The method of any one of items 1 to 16, the synthetic peptide shuttle agent of any one of items 17 to 20, the composition of item 21, the use of item 22, or the kit of item 23, wherein said polypeptide cargo comprises a cell penetrating domain.
26. The method of any one of items 1 to 16, 24 or 25, the synthetic peptide shuttle agent of any one of items 17 to 20, 24 or 25, the composition of any one of items 21, 24 or 25, the use of any one of items 22 to 25, wherein said polypeptide cargo comprises a subcellular targeting domain.

27. The method, the synthetic peptide shuttle agent, composition, use, or kit of item 26, wherein said subcellular targeting domain is:
 (a) a nuclear localization signal (NLS);
 (b) a nucleolar signal sequence;
 (c) a mitochondrial signal sequence; or
 (d) a peroxisome signal sequence.
28. The method, the synthetic peptide shuttle agent, composition, use, or kit of item 27, wherein: (a) said NLS is from: E1a, T-Ag, c-myc, T-Ag, op-T-NLS, Vp3, nucleoplasmin, histone 2B, *Xenopus* N1, PARP, PDX-1, QKI-5, HCDA, H2B, v-Rel, Amida, RanBP3, Pho4p, LEF-1, TCF-1, BDV-P, TR2, SOX9, or Max;
 (b) said nucleolar signal sequence is from BIRC5 or RECQL4;
 (c) said mitochondrial signal sequence is from Tim9 or Yeast cytochrome c oxidase subunit IV; or
 (d) said peroxisome signal sequence is from PTS1.
29. The method, the synthetic peptide shuttle agent, composition, use, or kit of any one of items 24 to 29, wherein said polypeptide cargo is complexed with a DNA and/or RNA molecule.
30. The method, the synthetic peptide shuttle agent, composition, use, or kit of any one of items 24 to 29, wherein said polypeptide cargo is a transcription factor, a nuclease, a cytokine, a hormone, a growth factor, an antibody, a peptide cargo, an enzyme, an enzyme inhibitor, or any combination thereof.
31. The method, the synthetic peptide shuttle agent, composition, use, or kit of item 30, wherein:
 (a) said transcription factor is: HOXB4, NUP98-HOXA9, Oct3/4, Sox2, Sox9, Klf4, c-Myc, MyoD, Pdx1, Ngn3, MafA, Blimp-1, Eomes, T-bet, FOX03A, NF-YA, SALL4, ISL1, FoxA1, Nanog, Esrrb, Lin28, HIF1-alpha, Hlf, Runx1t1, Pbx1, Lmo2, Zfp37, Prdm5, Bcl-6, or any combination thereof;
 (b) said nuclease is a catalytically active or catalytically dead: RNA-guided endonuclease, CRISPR endonuclease, type I CRISPR endonuclease, type II CRISPR endonuclease, type Ill CRISPR endonuclease, type IV CRISPR endonuclease, type V CRISPR endonuclease, type VI CRISPR endonuclease, CRISPR associated protein 9 (Cas9), Cpf1, CasY, CasX, zinc-finger nuclease (ZFNs), Transcription activator-like effector nucleases (TALENs), homing endonuclease, meganuclease, DNA-guided nuclease, Natronobacterium gregoryi Argonaute (NgAgo), or any combination thereof;
 (c) said antibody recognizes an intracellular antigen; and/or
 (d) said peptide cargo recognizes an intracellular molecule.
32. The method, the synthetic peptide shuttle agent, composition, use, or kit of any one of items 24 to 31, for use in cell therapy, genome editing, adoptive cell transfer, and/or regenerative medicine.
33. The method, the synthetic peptide shuttle agent, composition, use, or kit of any one of items 24 to 32, wherein said target eukaryotic cell is an animal cell, a mammalian cell, a human cell, a stem cell, a primary cell, an immune cell, a T cell, an NK cell, or a dendritic cell.
34. A eukaryotic cell comprising the shuttle agent as defined in any one of items 1 to 15, the synthetic peptide shuttle agent as defined in item 18, or the composition as defined in item 21.
35. The eukaryotic cell of item 34, which is an animal cell, a mammalian cell, a human cell, a stem cell, a primary cell, an immune cell, a T cell, an NK cell, or a dendritic cell.
36. A method for delivering one or more CRISPR-associated endonucleases alone or with one or more corresponding guide RNA and/or linear DNA templates, to a target eukaryotic cell, said method comprising contacting the target eukaryotic cell with the endonuclease in the presence of a shuttle agent at a concentration sufficient to increase the transduction efficiency of said endonuclease, as compared to in the absence of said shuttle agent, wherein said shuttle agent is as defined in any one of items 1 to 15.
37. The method of item 36, which is an in vitro method, or an in vivo method.
38. The method of item 36 or 37, wherein said one or more endonuclease is: a type I CRISPR endonuclease, a type II CRISPR endonuclease, a type Ill CRISPR endonuclease, a type IV CRISPR endonuclease, a type V CRISPR endonuclease, a type VI CRISPR endonuclease, or any combination thereof.
39. The method of item 36 or 37, wherein said one or more endonuclease is CRISPR associated protein 9 (Cas9), Cpf1, CasX, CasY, or any combination thereof; or a catalytically dead CRISPR associated protein 9 (dCas9), dCpf1, dCasX, dCasY, or any combination thereof.
40. The method of any one of items 36 to 39, wherein said target eukaryotic cell is an animal cell, a mammalian cell, a human cell, a stem cell, a primary cell, an immune cell, a T cell, an NK cell, or a dendritic cell.
41. The method of item 58, wherein said one or more corresponding guide RNA and/or linear DNA template targets one or more genes to reduce the immunogenicity, improve cytotoxicity, and/or otherwise improve the effectiveness of the target eukaryotic cell for cell-based therapy, as compared to a corresponding parent eukaryotic cell that has not been subjected to said method.
42. The method of item 41, wherein said cell-based therapy is cell-based cancer immunotherapy.
43. The method of any one of items 40 to 42, wherein said one or more corresponding guide RNA and/or linear DNA template targets the CBLB gene, c-CBL gene, GSK3 gene, ILT2 gene, CISH gene, NKG2a gene, B2M gene, or any combination thereof.
44. A method for producing a synthetic peptide shuttle agent that delivers a polypeptide cargo from an extracellular space to the cytosol and/or nucleus of a target eukaryotic cell, said method comprising synthesizing a peptide which is:
 (1) a peptide at least 20 amino acids in length comprising
 (2) an amphipathic alpha-helical motif having
 (3) a positively-charged hydrophilic outer face, and a hydrophobic outer face, wherein at least five of the following parameters (4) to (15) are respected:
 (4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
 (5) the peptide has a hydrophobic moment ($\mu$) of 3.5 to 11;
 (6) the peptide has a predicted net charge of at least +4 at physiological pH;

(7) the peptide has an isoelectric point (μI) of 8 to 13;
(8) the peptide is composed of 35% to 65% of any combination of the amino acids: A, C, G, I, L, M, F, P, W, Y, and V;
(9) the peptide is composed of 0% to 30% of any combination of the amino acids: N, Q, S, and T;
(10) the peptide is composed of 35% to 85% of any combination of the amino acids: A, L, K, or R;
(11) the peptide is composed of 15% to 45% of any combination of the amino acids: A and L, provided there being at least 5% of L in the peptide;
(12) the peptide is composed of 20% to 45% of any combination of the amino acids: K and R;
(13) the peptide is composed of 0% to 10% of any combination of the amino acids: D and E;
(14) the difference between the percentage of A and L residues in the peptide (% A+L), and the percentage of K and R residues in the peptide (K+R), is less than or equal to 10%; and
(15) the peptide is composed of 10% to 45% of any combination of the amino acids: Q, Y, W, P, I, S, G, V, F, E, D, C, M, N, T, and H.

45. The method of item 44, wherein the peptide is as defined in any one of items 2 to 15.

46. A method for identifying a shuttle agent that delivers a polypeptide cargo from an extracellular space to the cytosol and/or nucleus of a target eukaryotic cell, said method comprising:
  (a) synthesizing a peptide which is the peptide as defined in any one items 1 to 15 or 18;
  (b) contacting the target eukaryotic cell with the polypeptide cargo in the presence of said peptide;
  (c) measuring the transduction efficiency of the polypeptide cargo in the target eukaryotic cell; and
  (d) identifying the peptide as being a shuttle agent that transduces the polypeptide cargo, when an increase in the transduction efficiency of said polypeptide cargo in the target eukaryotic cell is observed.

47. The method of item 46, wherein said polypeptide cargo is as defined in any one of items 24 to 31.

48. A genome editing system comprising:
  (a) the shuttle agent as defined in any one items 1 to 15 or 18;
  (b) one or more CRISPR-associated endonucleases; and
  (c) one or more guide RNAs.

49. The genome editing system of item 48, further comprising a linear DNA template for controlling the genome editing.

50. The genome editing system of item 48 or 49, wherein said one or more CRISPR-associated endonucleases is: a type I CRISPR endonuclease, a type II CRISPR endonuclease, a type Ill CRISPR endonuclease, a type IV CRISPR endonuclease, a type V CRISPR endonuclease, a type VI CRISPR endonuclease, CRISPR associated protein 9 (Cas9), Cpf1, CasX, CasY, or any combination thereof.

51. A method for enriching eukaryotic cells transduced with a polypeptide cargo of interest, said method comprising:
  (a) co-transducing a target eukaryotic cell population with a polypeptide cargo of interest and a marker protein; and
  (b) isolating or concentrating eukaryotic cells transduced with the marker protein, thereby enriching eukaryotic cells transduced with the polypeptide cargo of interest.

52. The method of item 51, wherein:
  (i) the marker protein is not covalently bound to the polypeptide cargo of interest, the marker protein is covalently bound to the polypeptide cargo of interest, the marker protein is non-covalently bound to the polypeptide cargo of interest, or the marker protein is covalently bound to the polypeptide cargo of interest via a cleavable linker; and/or
  (ii) the marker protein comprises a detectable label, or the marker protein is a fluorescent protein, a fluorescently-labeled protein, a bioluminescent protein, an isotopically-labelled protein, or a magnetically-labeled protein.

53. The method of item 51 or 52, wherein the intracellular concentration of the transduced marker protein is positively correlated with the intracellular concentration of the transduced polypeptide cargo of interest.

54. The method of any one of items 51 to 53, wherein the eukaryotic cells transduced with the marker protein are isolated or concentrated using flow cytometry, fluorescence-activated cell sorting (FACS), or magnetic-activated cell sorting (MACS).

55. The method of any one of items 51 to 54, wherein the eukaryotic cells transduced with the marker protein are isolated or sorted from cells lacking the marker protein, thereby producing a marker protein-positive cell population and/or a marker protein-negative cell population.

56. The method of item 55, further comprising repeating steps (a) and (b), one or more times, on the marker protein-negative cell population, on the marker protein-positive cell population, or on both the marker protein-negative and the marker protein-positive cell populations.

57. The method of any one of items 51 to 56, wherein the eukaryotic cells transduced with the marker protein are isolated or sorted based on their intracellular concentration of the marker protein.

58. The method of any one of items 51 to 57, wherein the marker protein is a protein that stimulates cell proliferation, a protein that stimulates cell differentiation, a protein that promotes cell survival, an anti-apoptotic protein, or a protein having another biological activity.

59. The method of any one of items 51 to 58, wherein the polypeptide cargo of interest and the marker protein are co-transduced by contacting the target eukaryotic cell with the polypeptide cargo and the marker protein in the presence of a peptide transduction agent, wherein the peptide transduction agent is present at a concentration sufficient to increase the transduction efficiency of the polypeptide cargo and the marker protein, as compared to in the absence of said peptide transduction agent.

60. The method of item 59, wherein:
  (a) the peptide transduction agent is an endosomolytic peptide;
  (b) the peptide transduction agent is or comprises the synthetic peptide shuttle agent as defined in item 17 or 18;
  (c) the target eukaryotic cells comprise animal cells, mammalian cells, human cells, stem cells, primary cells, immune cells, T cells, NK cells, or dendritic cells;

(d) the polypeptide cargo of interest is: (i) the polypeptide cargo as defined in any one of items 24 to 31; and/or (ii) one or more CRISPR-associated endonucleases alone or with one or more corresponding guide RNA and/or linear DNA templates as defined in any one of items 38 to 43; or (e) any combination of (a) to (d).

Other objects, advantages and features of the present description will become more apparent upon reading of the following non-restrictive description of specific embodiments thereof, given by way of example only with reference to the accompanying drawings.

EXAMPLES

Example 1

Materials and Methods 1.1 Materials

All chemicals were purchased from Sigma-Aldrich (St. Louis, MO, USA or Oakville, ON, Canada) or equivalent grade from BioShop Canada Inc. (Mississauga, ON, Canada) or VWR (Ville Mont-Royal, QC, Canada), unless otherwise noted. 1.2 Reagents

TABLE 1.1

Reagents

| Material | Company | City, Province-State, Country |
|---|---|---|
| RPMI 1640 media | Sigma-Aldrich | Oakville, ON, Canada |
| DMEM | Sigma-Aldrich | Oakville, ON, Canada |
| Alpha MEM | Stem Cell Technology | Oakville, ON, Canada |
| Fetal bovine serum (FBS) | NorthBio | Toronto, ON, Canada |
| Horse serum | Invitrogen | Burlington, ON, Canada |
| L-glutamine-Penicillin-Streptomycin | Sigma-Aldrich | Oakville, ON, Canada |
| Trypsin-EDTA solution | Sigma-Aldrich | Oakville, ON, Canada |
| Inositol | Sigma-Aldrich | Oakville, ON, Canada |
| Folic acid | Sigma-Aldrich | Oakville, ON, Canada |
| pEGFP-C1 | CLONTECH Laboratories | Palo Alto, CA, USA |
| FITC-Antibody α-tubulin | Abcam ab64503 | Cambridge, MA, USA |
| ITS | Invitrogen/41400-045 | Burlington, ON, Canada |
| FGF 2 | Feldan Bio/1D-07-017 | Quebec, QC, Canada |
| Dexamethasone | Sigma-Aldrich/D8893 | Oakville, ON, Canada |
| Bovine serum albumin (BSA) | Sigma-Aldrich/A-1933 | Oakville, ON, Canada |
| MB1 media | GE Healthcare HyClone | Logan, Utah, USA |
| Calcein | Sigma-Aldrich/C0875 | Oakville, ON, Canada |
| HisTrap ™ FF column | GE Healthcare | Baie d'Urfe, QC, Canada |
| Q Sepharose ™ | GE Healthcare | Baie d'Urfe, QC, Canada |
| SP Sepharose ™ | GE Healthcare | Baie d'Urfe, QC, Canada |
| Amicon Ultra centrifugal filters | EMD Millipore | Etobicoke, ON Canada |
| Label IT ® Cy ®5 kit | Mirus Bio LLC | Madison, WI, USA |
| Calf serum | NorthBio | Toronto, ON, Canada |
| beta-mercaptoethanol | Sigma-Aldrich or Gibco-ThermoFisher | Oakville, ON, Canada |
| IL-2 | Feldan Bio/rhIL-2 Research | Quebec, QC, Canada |
| Resazurin sodium salt | Sigma-Aldrich/R7017-1G | Oakville, ON, Canada |
| Anti-HOXB4 monoclonal antibody | Novus Bio #NBP2-37257 | Oakville, ON, Canada |
| Alexa ™-594 Anti-Mouse | Abcam #150116 | Toronto, ON, Canada |
| Fluoroshield ™ with DAPI | Sigma #F6057 | Oakville, ON, Canada |
| GFP Monoclonal antibody | Feldan Bio #A017 | Quebec, QC, Canada |
| Phusion ™ High-Fidelity DNA polymerase | (NEB #M0530S) | Whitby, ON, Canada |
| Edit-R ™ Synthetic crRNA Positive Controls | (Dharmacon #U-007000-05) | Ottawa, ON, Canada |
| T7 Endonuclease I | (NEB, Cat #M0302S) | Whitby, ON, Canada |
| FastFect ™ transfection reagent | (Feldan Bio #9K-010-0001) | Quebec, QC, Canada |
| Goat Anti-Mouse IgG H&L (Alexa Fluor ®488) | Abcam ab150113 | Toronto, ON, Canada |
| Goat Anti-Rabbit IgG H&L (Alexa Fluor ® 594) | Abcam ab150080 | Toronto, ON, Canada |
| Opti-MEM ™ | Sigma-Aldrich | Oakville, ON, Canada |
| Anti-NUP98 | Abcam #ab50610 | Toronto, ON, Canada |
| PARP (Cleaved) [214/215] Human ELISA Kit | ThermoFisher #KHO0741 | Burlington, ON, Canada |
| Purified Rabbit Anti-Active Caspase-3 | BD Biosciences #559565 | Mississauga, ON, Canada |
| Active Caspace-3 antibody | Cedarlane #AF835 | Burlington, ON, Canada |
| TNF-alpha Antibody | BioVision Inc #3054-100 | Milpitas, CA, USA |
| APC Mouse Anti-Human HLA-ABC | BD Biosciences #555555 | Mississauga, ON, Canada |
| Anti-CD3 | Biolegend#cat: 300438 | San Diego, CA, USA |
| Anti-CD28 | Thermofisher #cat: 16-0289-85 | Burlington, ON, Canada |

1.3 Cell lines eDCu26,T1,M

HeLa, HEK293A, HEK293T, THP-1, CHO, NIH3T3, CA46, Balb3T3, HT2, KMS-12, DOHH2, RECA1, HCC-78, NCI-H196 and HT2 cells were obtained from American Type Culture Collection (Manassas, VA, USA) and cultured following the manufacturer's instructions. Myoblasts are primary human cells kindly provided by Professor J.P. Tremblay (Universite Laval, Quebec, Canada).Table 1.2: Cell lines and culture conditions

TABLE 1.2

Cell lines and culture conditions

| Cell lines | Description | ATCC/others | Culture media | Serum | Additives |
|---|---|---|---|---|---|
| HeLa (adherent cells) | Human cervical carcinoma cells | ATCC ™ CCL-2 | DMEM | 10% FBS | L-glutamine 2 mM<br>Penicillin 100 units<br>Streptomycin 100 µg/mL |
| HEK 293A (adherent cells) | Human embryonic Epithelial kidney cells | ATCC ™ CRL-1573 | DMEM | 10% FBS | L-glutamine 2 mM<br>Penicillin 100 units<br>Streptomycin 100 µg/mL |
| HEK 293T (adherent cells) | Human embryonic Epithelial kidney cells | ATCC ™ CRL-3216 | DMEM | 10% FBS | L-glutamine 2 mM<br>Penicillin 100 units<br>Streptomycin 100 µg/mL |
| THP-1 (suspension cells) | Acute monocytic leukemia | ATCC ™ TIB202 | RPMI 1640 | 10% FBS | β-mercaptoethanol 0.05 mM<br>L-glutamine 2 mM<br>Penicillin 100 units<br>Streptomycin 100 µg/mL |
| Myoblasts (primary adherent cells) | Human (13 months) myoblasts | Kindly provided by Professor J. P. Tremblay | MB1 | 15% FBS | ITS 1x, FGF 2 10 ng/mL,<br>Dexamethasone 0.39 µg/mL,<br>BSA 0.5 mg/mL,<br>MB1 85% |
| CHO (adherent cells) | Chinese hamster ovary cells | ATCC ™ CCL-61 | DMEM | 10% FBS | L-glutamine 2 mM<br>Penicillin 100 units<br>Streptomycin 100 µg/mL |
| NIH3T3 (adherent cells) | Fibroblasts | ATCC ™ CRL-1658 | DMEM | 10% Calf serum | L-glutamine 2 mM<br>Penicillin 100 units<br>Streptomycin 100 µg/mL |
| HT2 (suspension cells) | T lymphocytes | ATCC ™ CRL-1841 | RPMI 1640 | 10% FBS | 200 IU/mL IL-2<br>β-mercaptoethanol 0.05 mM<br>L-glutamine 2 mM<br>Penicillin 100 units<br>Streptomycin 100 µg/mL |
| CA46 (suspension cells) | *Homo sapiens* Burkitt's lymphoma | ATCC ™ CRL-1648 | RPMI 1640 | 20% FBS | L-glutamine 2 mM<br>Penicillin 100 units<br>Streptomycin 100 µg/mL |
| Balb3T3 (adherent cells) | Fibroblasts | ATCC ™ CCL-163 | DMEM | 10% Calf serum | L-glutamine 2 mM<br>Penicillin 100 units<br>Streptomycin 100 µg/mL |
| Jurkat (suspension cells) | Human T cells | ATCC ™ TIB-152 | RPMI 1640 | 10% FBS | L-glutamine 2 mM<br>Penicillin 100 units<br>Streptomycin 100 µg/mL |
| DOHH2 (suspension cells) | Human B cell lymphoma | Gift from Horizon Inc. | RPMI 1640 | 10% FBS | L-glutamine 2 mM<br>Penicillin 100 units<br>Streptomycin 100 µg/mL |
| KMS-12 (suspension cells) | Myeloma bone marrow | Gift from Horizon Inc. | Advanced RPMI 1640 | 10% FBS | L-glutamine 2 mM<br>Penicillin 100 units<br>Streptomycin 100 µg/mL |
| REC-1 (suspension cells) | Human lymph node mantel cell | Gift from Horizon Inc. | RPMI 1640 | 10% FBS | L-glutamine 2 mM<br>Penicillin 100 units<br>Streptomycin 100 µg/mL |
| HCC-78 (adherent cells) | Human adenocarcinoma lung cell | Gift from Horizon Inc. | RPMI 1640 | 20% FBS | L-glutamine 2 mM<br>Penicillin 100 units<br>Streptomycin 100 µg/mL |
| NCI-H196 (adherent cells) | Human small cell lung cancer | Gift from Horizon Inc. | RPMI 1640 | 10% FBS | L-glutamine 2 mM<br>Penicillin 100 units<br>Streptomycin 100 µg/mL |
| NK (suspension cells) | Human normal Peripheral Blood CD56+ lymphocyte | All cells ™ #PB012-PF | RPMI 1640 | 10% FBS | 200 IU/mL IL-2<br>L-glutamine 2 mM<br>Penicillin 100 units<br>Streptomycin 100 µg/mL |
| NK-92 (suspension cells) | Human normal Peripheral Blood CD56+ lymphocyte | Gift from CETC | Alpha MEM | 12.5% FBS<br>12.5% Horse serum | L-glutamine 200 nM<br>IL-2 25000 U/mL<br>Inositol 1M<br>Folic acid 100 nM<br>B-ME 55 mM |
| T cells (suspension cells) | Human normal Peripheral Blood CD3+ lymphocyte | Healthy blood donor | RPMI advanced | 10% FBS | L-glutamine 200 nM<br>IL-2 25000 U/mL<br>Penicillin 100 units<br>Streptomycin 100 µg/mL |

FBS: Fetal bovine serum 1.4 Protein Purification

Fusion proteins were expressed in bacteria (*E. coli* BL21DE3) under standard conditions using an isopropyl p-D-1-thiogalactopyranoside (IPTG) inducible vector containing a T5 promoter. Culture media contained 24 g yeast extract, 12 g tryptone, 4 mL glycerol, 2.3 g $KH_2PO_4$, and 12.5 g $K_2HPO_4$ per liter. Bacterial broth was incubated at 37° C. under agitation with appropriate antibiotic (e.g., ampicillin). Expression was induced at optical density (600 nm) between 0.5 and 0.6 with a final concentration of 1 mM IPTG for 3 hours at 30° C. Bacteria were recuperated following centrifugation at 5000 RPM and bacterial pellets were stored at −20° C.

Bacterial pellets were resuspended in Tris buffer (Tris 25 mM pH 7.5, NaCl 100 mM, imidazole 5 mM) with phenylmethylsulfonyl fluoride (PMSF) 1 mM, and lysed by passing 3 times through the homogenizer Panda 2K™ at 1000 bar. The solution was centrifuged at 15000 RPM, 4° C. for 30 minutes. Supernatants were collected and filtered with a 0.22 µM filtration device.

Solubilized proteins were loaded, using a FPLC (AKTA Explorer 100R), on HisTrap™ FF column previously equilibrated with 5 column volumes (CV) of Tris buffer. The column was washed with 30 column volumes (CV) of Tris buffer supplemented with 0.1% Triton™ X-114 followed with 30 CV of Tris buffer with imidazole 40 mM. Proteins were eluted with 5 CV of Tris buffer with 350 mM Imidazole and collected. Collected fractions corresponding to specific proteins were determined by standard denaturing SDS-PAGE.

Purified proteins were diluted in Tris 20 mM at the desired pH according to the protein's pI and loaded on an appropriate ion exchange column (Q Sepharos™ or SP Sepharose™) previously equilibrated with 5 CV of Tris 20 mM, NaCl 30 mM. The column was washed with 10 CV of Tris 20 mM, NaCl 30 mM and proteins were eluted with a NaCl gradient until 1 M on 15 CV. Collected fractions corresponding to specific proteins were determined by standard denaturing SDS-PAGE. Purified proteins were then washed and concentrated in PBS 1X on Amicon Ultra™ centrifugal filters 10,000 MWCO. Protein concentration was evaluated using a standard Bradford assay.

1.5 Synthetic Peptides and Shuttle Agents

All peptides used in this study were purchased from GLBiochem (Shanghai, China) and their purities were confirmed by high-performance liquid chromatography analysis and mass spectroscopy. In some cases, peptides were synthesized to contain a C-terminal cysteine residue to allow the preparation of peptide dimers. These dimeric peptides were directly synthetized with a disulfide bridge between the C-terminal cysteines of two monomers. The amino acid sequences and characteristics of each of the synthetic peptides and shuttle agents tested in the present examples are summarized in Table 1.3, Table B1, and Table C1.

TABLE 1.3

Synthetic peptides and shuttle agents

| Domain(s) | Peptide or Shuttle agent | Amino acid (a.a.) sequence [SEQ ID NO; not including C-terminal Cys, unless indicated with an *] | a.a. | MW (kDa) | pI | Charge | Hydropathicity index |
|---|---|---|---|---|---|---|---|
| ELD | CM18 | KWKLFKKIGAVLKVLTTG [1] | 18 | 2.03 | 10.60 | 5+/0− | 0.350 |
| | C(LLKK)₃C | CLLKKLLKKLLKKC [63] | 14 | 1.69 | 10.05 | 6+/0− | 0.314 |
| | LAH4 | KKALLALALHHLAHLALHLALALKKA [6] | 26 | 2.78 | 10.48 | 4+/0− | 0.923 |
| | KALA | WEAKLAKALAKALAKHLAKALAKALKACEA [14] | 30 | 3.13 | 9.9 | 7+/2− | 0.283 |
| CPD | TAT-cys | YGRKKRRQRRRC [17] | 12 | 1.66 | 12.01 | 8+/0− | −3.125 |
| | Penetratin-cys | RQIKIWFQNRRMKWKKC [18] | 17 | 2.35 | 11.75 | 7+/0− | −1.482 |
| | PTD4 | YARAAARQARA [65] | 11 | 1.2 | 11.72 | 3+/0− | −0.682 |
| His-PTD4 | His-PTD4 | HHHHHHHYARAAARQARA [81] | 17 | 2.03 | 11.71 | 3+/0− | −1.57 |
| CPD-ELD | TAT-CM18 | YGRKKRRQRRRCKWKLFKKIGAVLKVLTTG [66] | 30 | 3.68 | 12.02 | 13+/0− | −1.041 |
| | TAT-KALA | YGRKKRRQRRRCWEAKLAKALAKALAKHLAKALAKALKACEA [67] | 42 | 4.67 | 11.46 | 15+/2− | −0.768 |
| | PTD4-KALA | YARAAARQARAWEAKLAKALAKALAKHLAKALAKALKACEA [82] | 41 | 4.32 | 10.46 | 10+/2− | 0.024 |
| | 9Arg-KALA | RRRRRRRRRWEAKLAKALAKALAKHLAKALAKALKACEA [83] | 39 | 4.54 | 12.11 | 16+/2− | −0.821 |
| | Pep1-KALA | KETWWETWWTEWSQPKKKRKVWEAKLAKALAKALAKHLAKALAKALKACEA [84] | 51 | 5.62 | 10.01 | 13+/5− | −0.673 |
| | Xentry-KALA | LCLRPVGWEAKLAKALAKALAKHLAKALAKALKACEA [85] | 37 | 3.87 | 9.93 | 8+/2− | 0.441 |
| | SynB3-KALA | RRLSYSRRRFWEAKLAKALAKALAKHLAKALAKALKACEA [86] | 40 | 4.51 | 11.12 | 12+/2− | −0.258 |
| ELD-CPD | CM18-TAT-Cys | KWKLFKKIGAVLKVLTTGYGRKKRRQRRRC [57] | 30 | 3.67 | 12.02 | 13+/0− | −1.04 |
| | CM18-Penetratin-Cys | KWKLEKKIGAVLKVLTTGRQIKIWFQNRRMKWKKC [58] | 35 | 4.36 | 11.36 | 12+/0− | −0.54 |
| | dCM18-TAT-Cys (CM18-TAT-cys dimer) | KWKLFKKIGAVLKVLTTGYGRKKRRQRRRC [57] KWKLFKKIGAVLKVLTTGYGRKKRRQRRRC [57] | 60 | 7.34 | 12.16 | 26+/0− | −1.04 |

TABLE 1.3-continued

Synthetic peptides and shuttle agents

| Domain(s) | Peptide or Shuttle agent | Amino acid (a.a.) sequence [SEQ ID NO; not including C-terminal Cys, unless indicated with an *] | a.a. | MW (kDa) | pI | Charge | Hydro-pathi-city index |
|---|---|---|---|---|---|---|---|
| | dCM18-Penetratin-Cys (CM18-Penetratin-Cys dimer) | KWKLFKKIGAVLKVLTTGRQIKIWFQNRRMKWKKC [58] | 70 | 8.72 | 12.05 | 24+/0- | -0.54 |
| | VSVG-PTD4 | KFTIVFPHNQKGNWKNVPSNYHYCPYARAAARQARA [87] | 36 | 4.2 | 10.3 | 6+/0- | -0.89 |
| | EB1-PTD4 | LIRLWSHLIHIWFQNRRLKWKKKYARAAARQARA [88] | 34 | 4.29 | 12.31 | 10+/0- | -0.647 |
| | JST-PTD4 | GLFEALLELLESLWELLLEAYARAAARQARA [89] | 31 | 3.49 | 4.65 | 5+/3- | 0.435 |
| | CM18-PTD4 | KWKLFKKIGAVLKVLTTGYARAAARQARA [90] | 29 | 3.217 | 11.76 | 8+/0- | -0.041 |
| | 6Cys-CM18-PTD4 | CCCCCCKWKLFKKIGAVLKVLTTGYARAAARQARA [91] | 35 | 3.835 | 9.7 | 8+/0- | 0.394 |
| | CM18-L1-PTD4 | KWKLFKKIGAVLKVLTTGGGSYARAAARQARA [92] | 32 | 3.42 | 11.76 | 8+/0- | -0.087 |
| | CM18-L2-PTD4 | KWKLFKKIGAVLKVLTTGGGSGGGSYARAAARQARA [93] | 36 | 3.68 | 11.76 | 8+/0- | -0.133 |
| | CM18-L3-PTD4 | KWKLFKKIGAVLKVLTTGGGSGGGSGGGSGYARAAARQARA [94] | 41 | 3.99 | 11.76 | 8+/0- | -0.176 |
| His-ELD-CPD | Met-His-CM18-TAT-Cys | MHHHHHHKWKLFKKIGAVLKVLTTGYGRKKRRQRRRC [59*] | 37 | 4.63 | 12.02 | 13+/0- | -1.311 |
| | His-CM18-TAT | HHHHHHKWKLFKKIGAVLKVLTTGYGRKKRRQRRR [95] | 35 | 4.4 | 12.31 | 13+/0- | -1.208 |
| | His-CM18-PTD4 | HHHHHHKWKLFKKIGAVLKVLTTCYARAAARQARA [68] | 35 | 4.039 | 11.76 | 8+/0- | -0.583 |
| | His-CM18-PTD4-6Cys | HHHHHHKWKLFKKIGAVLKVLTTGYARAAARQARACCCCCC [96*] | 41 | 4.659 | 9.7 | 8+/0- | -0.132 |
| | His-CM18-9Arg | HHHHHHKWKLFKKIGAVLKVLTTGRRRRRRRRR [69] | 33 | 4.26 | 12.91 | 14+/0- | -1.618 |
| | His-CM18-Transportan | HHHHHHKWKLFKKIGAVLKVLTTGGWTLNSAGYLLKINLKALAALAKKIL [70] | 50 | 5.62 | 10.6 | 9+/0- | 0.092 |
| | His--PTD4 | HHHHHHKKALLALALHHLAHLALHLALALKKAYARAAARQARA [71] | 43 | 4.78 | 11.75 | 7+/0- | -0.63 |
| | His-C(LLKK)₃C-PTD4 | HHHHHHCLLKKLLKKLLKKCYARAAARQARA [72] | 31 | 3.56 | 11.21 | 9+/0- | -0.827 |
| | 3His-CM18-PTD4 | HHHKWKLFKKIGAVLKVLTTGYARAAARQARA [97] | 32 | 3.63 | 11.76 | 8+/0- | -0.338 |
| | 12His-CM18-PTD4 | HHHHHHHHHHHHKWKLFKKIGAVLKVLTTGYARAAARQARA [98] | 41 | 4.86 | 11.78 | 8+/0- | -0.968 |
| | HA-CM18-PTD4 | HHHAHHHKWKLFKKIGAVLKVLTTGYARAAARQARA [99] | 36 | 4.11 | 11.76 | 8+/0- | -0.517 |
| | 3HA-CM18-PTD4 | HAHHAHHAHKWKLFKKIGAVLKVLTTGYARAAARQARA [100] | 38 | 4.25 | 11.78 | 8+/0- | -0.395 |
| ELD-His-CPD | CM18-His-PTD4 | KWKLFKKIGAVLKVLTTGHHHHHHYARAAARQARA [101] | 35 | 4.04 | 11.76 | 8+/0- | -0.583 |
| His-ELD-CPD-His | His-CM18-PTD4-His | HHHHHHKWKLFKKIGAVLKVLTTGYARAAARQARAHHHHHH [102] | 41 | 4.86 | 11.76 | 8+/0- | -0.966 |

Results computed using the ProtParam™ online tool available from ExPASy™ Bioinformatics Resource Portal (http://web.expasy.org/protparam/)
MW: Molecular weight
pI: Isoelectric point
Charge: Total number of positively (+) and negatively (-) charged residues Example 2

Peptide shuttle agents facilitate escape of endosomally-trapped calcein 2.1 Endosome escape assays Microscopy-based and flow cytometry-based fluorescence assays were developed to study endosome leakage and to determine whether the addition of the shuttle agents facilitates endosome leakage of the polypeptide cargo. These methods are described in Example 2 of PCT/CA2016/050403.

2.1.1 Endosomal leakage visualization by microscopy

Calcein is a membrane-impermeable fluorescent molecule that is readily internalized by cells when administered to the extracellular medium. Its fluorescence is pH-dependent and calcein self-quenches at higher concentrations. Once internalized, calcein becomes sequestered at high concentrations in cell endosomes and can be visualized by fluorescence microscopy as a punctate pattern. Following endosomal leakage, calcein is released to the cell cytoplasm and this release can be visualized by fluorescence microscopy as a diffuse pattern.

One day before the calcein assay was performed, cells in exponential growth phase were harvested and plated in a 24-well plate (80,000 cells per well). The cells were allowed to attach by incubating overnight in appropriate growth media, as described in Example 1. The next day, the media was removed and replaced with 300 µL of fresh media without FBS containing 62.5 µg/mL (100 µM) of calcein, except for HEK293A (250 µg/mL, 400 µM). At the same time, the shuttle agent(s) to be tested was added at a predetermined concentration. The plate was incubated at 37° C. for 30 minutes. The cells were washed with 1× PBS (37° C.) and fresh media containing FBS was added. The plate was incubated at 37° C. for 2.5 hours. The cells were washed three times and were visualized by phase contrast and fluorescence microscopy (IX81™, Olympus).

Figure 1A:
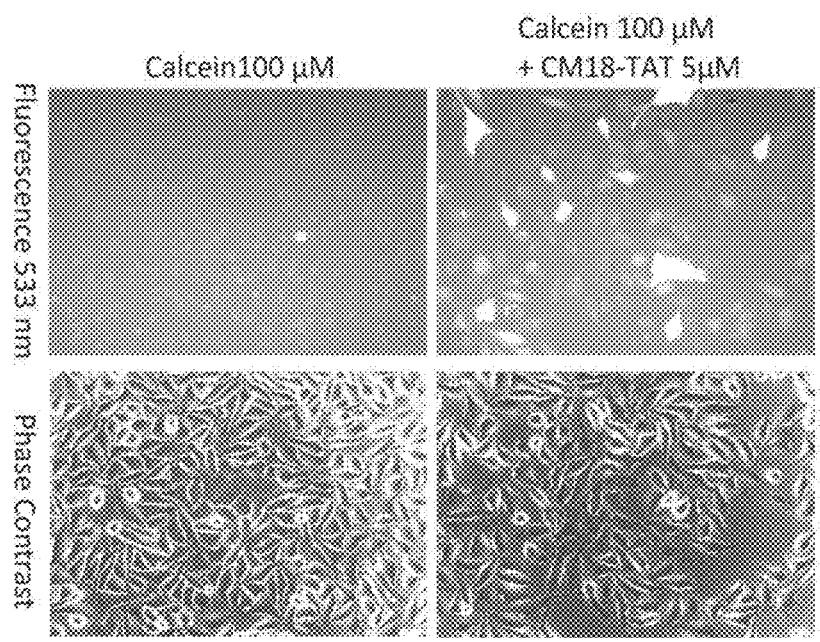
FIGS. 1A and 1B show a typical result of a calcein endosomal escape assay in which HEK293A cells were loaded with the fluorescent dye calcein ("100 μM calcein"), and were then treated (or not) with a shuttle agent that facilitates endosomal escape of the calcein ("100 μM calcein+CM18-TAT 5 μM").

A typical result is shown in FIG. 1A, in which untreated HEK293A cells loaded with calcein (100 µM calcein") show a low intensity, punctate fluorescent pattern when visualized by fluorescence microscopy (upper left panel). In contrast, HeLa cells treated with a shuttle agent that facilitates endosomal escape of calcein ("100 µM calcein+CM18-TAT 5 µM") show a higher intensity, more diffuse fluorescence pattern in a greater proportion of cells (upper right panel).

2.1.2 Endosomal Leakage Quantification by Flow Cytometry

In addition to microscopy, flow cytometry allows a more quantitative analysis of the endosomal leakage as the fluorescence intensity signal increases once the calcein is released in the cytoplasm. Calcein fluorescence is optimal at physiological pH (e.g., in the cytosol), as compared to the acidic environment of the endosome.

One day before the calcein assay was performed, cells in exponential growth phase were harvested and plated in a 96-well plate (20,000 cells per well). The cells were allowed to attach by incubating overnight in appropriate growth media, as described in Example 1. The next day, the media in wells was removed and replaced with 50 µL of fresh media without serum containing 62.5 µg/mL (100 µM) of calcein, except for HEK293A (250 µg/mL, 400 µM). At the same time, the shuttle agent(s) to be tested was added at a predetermined concentration. The plate was incubated at 37° C. for 30 minutes. The cells were washed with 1× PBS (37° C.) and fresh media containing 5-10% serum was added. The plate was incubated at 37° C. for 2.5 hours. The cells were washed with 1× PBS and detached using trypsinization. Trypsinization was stopped by addition of appropriate growth media, and calcein fluorescence was quantified using flow cytometry (Accuri C6, Becton, Dickinson and Company (BD)).

Untreated calcein-loaded cells were used as a control to distinguish cells having a baseline of fluorescence due to endosomally-trapped calcein from cells having increased fluorescence due to release of calcein from endosomes. Fluorescence signal means ("mean counts") were analyzed for endosomal escape quantification. In some cases, the "Mean Factor" was calculated, which corresponds to the fold-increase of the mean counts relative to control (untreated calcein-loaded cells). Also, the events scanned by flow cytometry corresponding to cells (size and granularity) were analyzed. The cellular mortality was monitored with the percentage of cells in the total events scanned. When it became lower than the control, it was considered that the number of cellular debris was increasing due to toxicity and the assay was discarded.

Figure 1B:
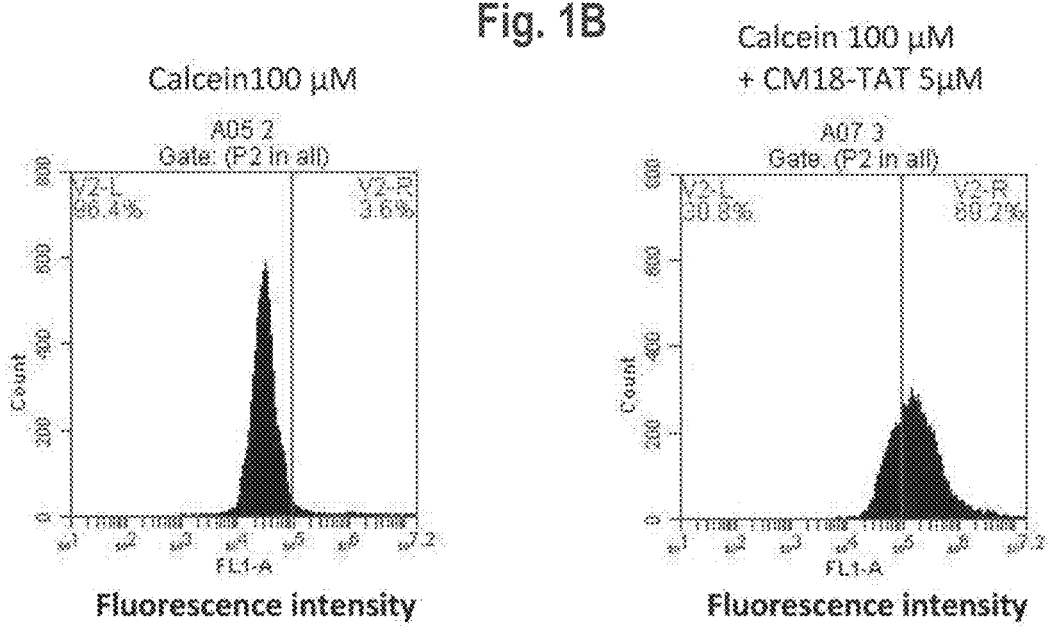

A typical result is shown in FIG. 1B, in which an increase in fluorescence intensity (right-shift) is observed for calcein-loaded HeLa cells treated with a shuttle agent that facilitates endosomal escape ("Calcein 100 µM+CM18-TAT 5 µM", right panel), as compared to untreated calcein-loaded HeLa cells ("Calcein 100 µM", left panel). The increase in calcein fluorescence is caused by the increase in pH associated with the release of calcein from the endosome (acidic) to the cytoplasm (physiological).

2.2 Results from Endosome Escape Assays
2.2.1 HeLa Cells

HeLa cells were cultured and tested in the endosomal escape assays as described in Example 2.1. The results of flow cytometry analyses are summarized below. In each case, the flow cytometry results were also confirmed by fluorescence microscopy (data not shown).

TABLE 2.1

CM18-Penetratin-Cys v. Controls in Hela cells

| Domains | Peptide | Cells | Concentration (µm) | Mean Counts (±St Dev.: n = 3) | Mean Factor |
|---|---|---|---|---|---|
| — | No peptide | HeLa | 0 | 55 359 ± 6844 | 1.0 |
| ELD | CM18 | HeLa | 5 | 46 564 ± 9618 | 0.8 |
| CPD | TAT-Cys | HeLa | 5 | 74 961 ± 9337 | 1.3 |
|  | Penetratin-Cys | HeLa | 5 | 59 551 ± 7119 | 1.1 |
| ELD + CPD | CM18 + TAT-Cys | HeLa | 5 + 5 | 64 333 ± 6198 | 1.2 |
|  | CM18 + Penetratin-Cys | HeLa | 5 + 5 | 40 976 ± 8167 | 0.7 |
| ELD – CPD | CM18 – Penetratin-Cys | HeLa | 5 | 262 066 ± 28 146 | 4.7 |

TABLE 2.2

CM18-TAT-Cys v. Control in HeLa cells

| Domains | Peptide | Cells | Concentration (µM) | Mean counts (n = 3) | Stand. dev. | Mean Factor |
|---|---|---|---|---|---|---|
| — | No peptide | HeLa | 0 | 53 369 | 4192 | 1.0 |
| ELD-CPD | CM18-TAT-Cys | HeLa | 5 | 306 572 | 46 564 | 5.7 |

The results in Tables 2.1 and 2.2 show that treating calcein-loaded HeLa cells with the shuttle agents CM18-Penetratin-Cys and CM18-TAT-Cys (having the domain structure ELD-CPD) results in increased mean cellular calcein fluorescence intensity, as compared to untreated control cells or cells treated with single-domain peptides used alone (CM 18, TAT-Cys, Penetratin-Cys) or together (CM18+TAT-Cys, CM18+Penetratin-Cys). These results suggest that CM18-Penetratin-Cys and CM18-TAT-Cys facilitate escape of endosomally-trapped calcein, but that single domain peptides (used alone or together) do not.

TABLE 2.3

Figure 2:
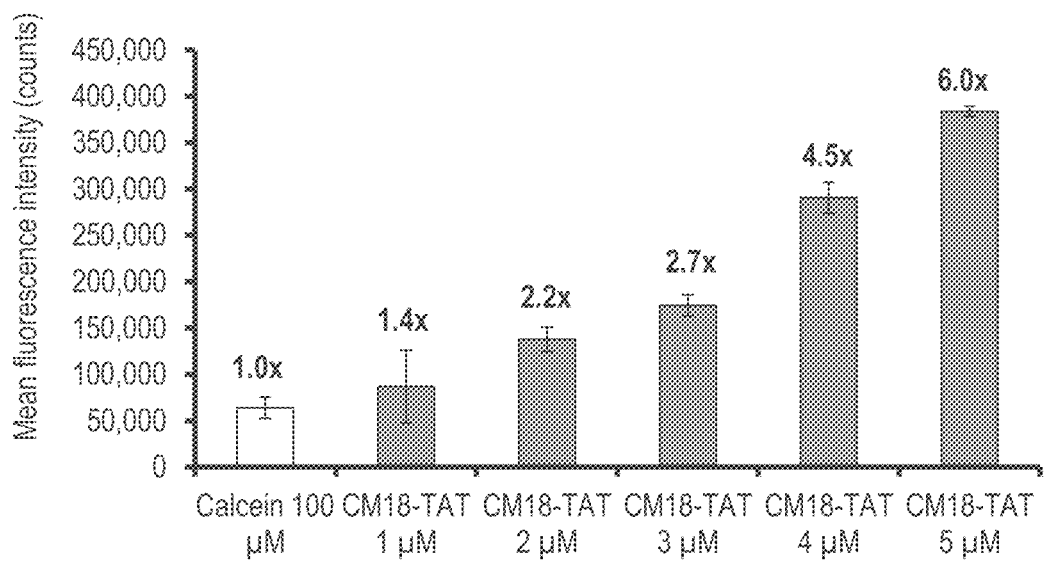
FIG. 2 shows the results of a calcein endosomal escape flow cytometry assay in which HeLa cells were loaded with calcein ("calcein 100 μM"), and were then treated with increasing concentrations of the shuttle agent CM18-TAT-Cys (labeled "CM18-TAT").

Dose response of CM18-TAT-Cys in HeLa cells, data from FIG. 2

| Domains | Peptide | Cells | Concentration (μM) | Mean counts (n = 3) | Stand. dev. | Mean Factor |
| --- | --- | --- | --- | --- | --- | --- |
| — | No peptide ("calcein 100 μM") | HeLa | 0 | 63 872 | 11 587 | 1.0 |
| ELD-CPD | CM18-TAT-Cys | HeLa | 1 | 86 919 | 39 165 | 1.4 |
|  | CM18-TAT-Cys | HeLa | 2 | 137 887 | 13 119 | 2.2 |
|  | CM18-TAT-Cys | HeLa | 3 | 174 327 | 11 519 | 2.7 |
|  | CMl8-TAT-Cys | HeLa | 4 | 290 548 | 16 593 | 4.5 |
|  | CMl8-TAT-Cys | HeLa | 5 | 383 685 | 5578 | 6.0 |

TABLE 2.4

Dose response of CM18-TAT-Cys in HeLa cells

| Domains | Peptide | Cells | Concentration (μM) | Mean counts (n = 3) | Stand. dev. | Mean Factor |
| --- | --- | --- | --- | --- | --- | --- |
| — | No peptide | HeLa | 0 | 81 013 | 14 213 | 1.0 |
| ELD-CPD | CM18-TAT-Cys | HeLa | 3 | 170 652 | 63 848 | 2.1 |
|  | CM18-TAT-Cys | HeLa | 4 | 251 799 | 33 880 | 3.1 |
|  | CM18-TAT-Cys | HeLa | 5 | 335 324 | 10 651 | 4.1 |

TABLE 2.5

Figure 3:
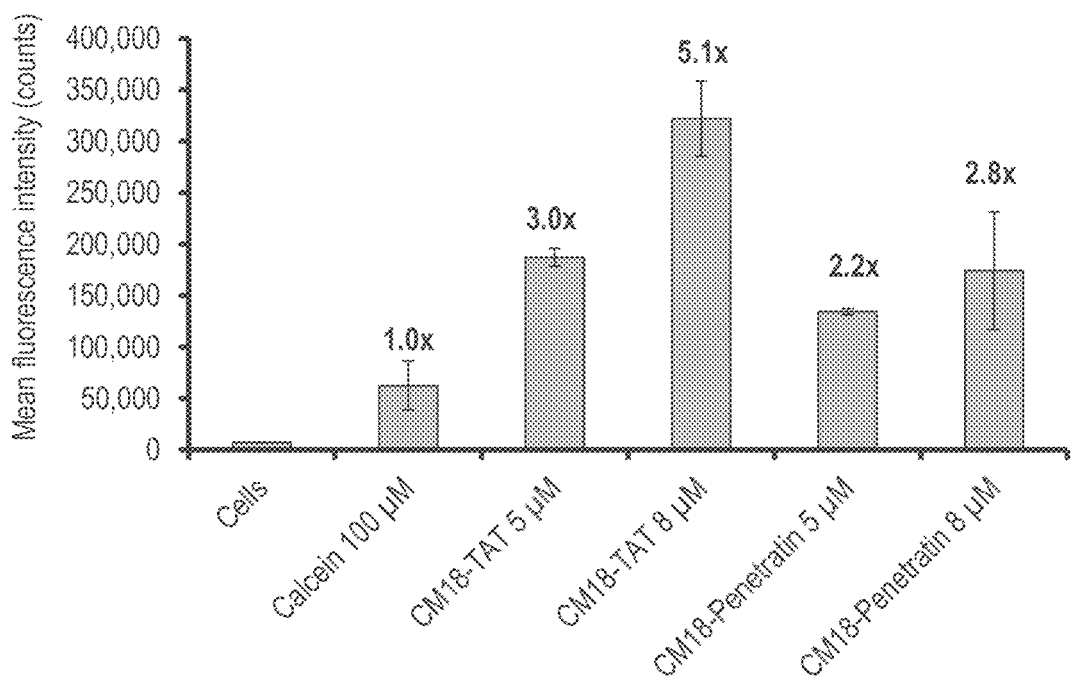
FIGS. 3 and 4 show the results of calcein endosomal escape flow cytometry assays in which HeLa cells (FIG. 3) or primary myoblasts (FIG. 4) were loaded with calcein ("calcein 100 μM"), and were then treated with 5 μM or 8 μM of the shuttle agents CM18-TAT-Cys or CM18-Penetratin-Cys (labeled "CM18-TAT" and "CM18-Penetratin", respectively).

Dose response of CM18-TAT-Cys and CM18-Penetratin-Cys in HeLa cells, data from FIG. 3

| Domains | Peptide | Cells | Concentration (μM) | Mean counts (n = 3) | Stand. dev. | Mean Factor |
| --- | --- | --- | --- | --- | --- | --- |
| — | No peptide | HeLa | 0 | 62 503 | 23 752 | 1.0 |
| ELD-CPD | CM18-TAT-Cys | HeLa | 5 | 187 180 | 8593 | 3.0 |
|  | CM18-TAT-Cys | HeLa | 8 | 321 873 | 36 512 | 5.1 |
|  | CM18-Penetratin-Cys | HeLa | 5 | 134 506 | 2992 | 2.2 |
|  | CM18-Penetratin-Cys | HeLa | 8 | 174 233 | 56 922 | 2.8 |

The results in Tables 2.3 (FIG. 2), 2.4, and 2.5 (FIG. 3) suggest that CM18-TAT-Cys and CM18-Penetratin-Cys facilitate escape of endosomally-trapped calcein in HeLa cells in a dose-dependent manner. In some cases, concentrations of CM18-TAT-Cys or CMl18-Penetratin-Cys above 10 μM were associated with an increase in cell toxicity in HeLa cells.

TABLE 2.6

Dimers v. monomers of CM18-TAT-Cys and CM18-Penetratin-Cys in HeLa cells

| Domains | Peptide | Cells | Concentration (µM) | Mean counts (n = 4) | Stand. dev. | Mean Factor |
|---|---|---|---|---|---|---|
| — | No peptide | HeLa | 0 | 60 239 | 9860 | 1.0 |
| ELD-CPD | CM18-TAT-Cys | HeLa | 4 | 128 461 | 25 742 | 2.1 |
|  | CM18-Penetratin-Cys | HeLa | 4 | 116 873 | 3543 | 1.9 |
| ELD-CPD dimer | dCM18-TAT-Cys | HeLa | 2 | 79 380 | 4297 | 1.3 |
|  | dCM18-Penetratin-Cys | HeLa | 2 | 128 363 | 8754 | 2.1 |

TABLE 2.7

Monomers v. dimers of CM18-TAT-Cys and CM18-Penetratin-Cys in HeLa cells

| Domains | Peptide | Cells | Concentraton (µM) | Mean counts (n = 3) | Stand. dev. | Mean Factor |
|---|---|---|---|---|---|---|
| — | No peptide | HeLa | 0 | 55 834 | 1336 | 1.0 |
| ELD-CPD | CM18-TAT-Cys | HeLa | 4 | 159 042 | 16 867 | 2.8 |
| ELD-CPD dimer | dCM18-TAT-Cys | HeLa | 2 | 174 274 | 9 553 | 3.1 |

The results in Table 2.6 and 2.7 suggest that shuttle peptide dimers (which are molecules comprising more than one ELD and CPD) are able to facilitate calcein endosomal escape levels that are comparable to the corresponding monomers.

2.2.3 HEK293A Cells

To examine the effects of the shuttle agents on a different cell line, HEK293A cells were cultured and tested in the endosomal escape assays as described in Example 2.1. The results of flow cytometry analyses are summarized below in Table 2.8 and in FIG. 1B.

TABLE 2.8

CM18-TAT-Cys in HEK293A cells

| Domains | Peptide | Cells | Concentration (µM) | Mean counts (n = 2) | Stand. dev. | Mean Factor |
|---|---|---|---|---|---|---|
| — | No peptide | HEK293A | 0 | 165 819 | 7693 | 1.0 |
| ELD-CPD | CM18-TAT-Cys | HEK293A | 0.5 | 196 182 | 17 224 | 1.2 |
|  | CM18-TAT-Cys | HEK293A | 5 | 629 783 | 1424 | 3.8 |

The results in Table 2.8 and in FIG. 1B show that treating calcein-loaded HEK293A cells with the shuttle agent CM18-TAT-Cys results in increased mean cellular calcein fluorescence intensity, as compared to untreated control cells.

2.2.2 Myoblasts

To examine the effects of the shuttle agents on primary cells, primary myoblast cells were cultured and tested in the endosomal escape assays as described in Example 2.1. The results of flow cytometry analyses are summarized below in Tables 2.9 and 2.10, and in FIG. 4. In each case, the flow cytometry results were also confirmed by fluorescence microscopy.

TABLE 2.9

Figure 4:
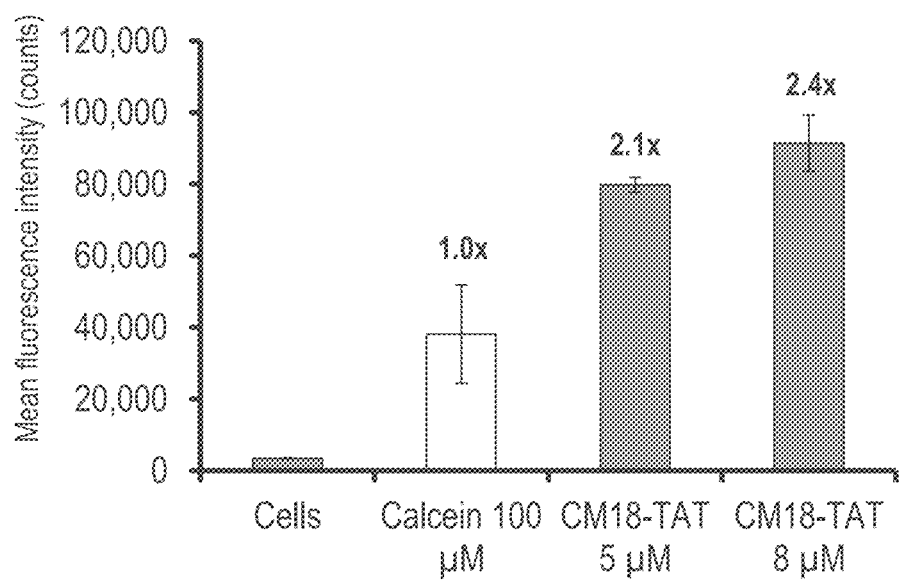

Dose response of CM18-TAT-Cys in primary myoblasts, data from FIG. 4

| Domains | Peptide | Cells | Peptide Conc. (µM) | Mean counts (n = 3) | Stand. dev. | Mean Factor |
|---|---|---|---|---|---|---|
| — | No peptide; no calcein ("Cells") | Myoblasts | 0 | 863 | 61 | n/a |
| — | No peptide ("Calcein 100 µM") | Myoblasts | 0 | 38 111 | 13 715 | 1.0 |
| ELD-CPD | CM18-TAT-Cys | Myoblasts | 5 | 79 826 | 12 050 | 2.1 |
|  | CM18-TAT-Cys | Myoblasts | 8 | 91 421 | 10 846 | 2.4 |

TABLE 2.10

Dose response of CM18-TAT-Cys in primary myoblasts

| Domains | Peptide | Cells | Peptide Conc. (µM) | Mean counts (n = 3) | Stand. dev. | Mean Factor |
|---|---|---|---|---|---|---|
| — | No peptide | Myoblasts | 0 | 31 071 | 21 075 | 1.0 |
| ELD-CPD | CM18-TAT-Cys | Myoblasts | 5 | 91 618 | 10 535 | 2.9 |
|  | CM18-TAT-Cys | Myoblasts | 7.5 | 95 289 | 11 266 | 3.1 |

The results in Table 2.9 (shown graphically in FIG. 4) and Table 2.10 suggest that CM18-TAT-Cys facilitates escape of endosomally-trapped calcein in a dose-dependent manner in primary myoblasts. Concentrations of CM18-TAT-Cys above 10 µM were associated with an increase in cell toxicity in myoblast cells, as for HeLa cells.

TABLE 2.11

Monomers v. dimers CM18-TAT-Cys and CM18-Penetratin-Cys in primary myoblasts

| Domains | Peptide | Cells | Concentration (µM) | Mean counts | Stand. dev. | Mean Factor |
|---|---|---|---|---|---|---|
| — | No peptide | Myoblasts | 0 | 30 175 | 4687 | 1.0 |
| ELD-CPD | CM18-TAT-Cys | Myoblasts | 5 | 88 686 | 19 481 | 2.9 |
| ELD-CPD dimer | dCM18-TAT-Cys | Myoblasts | 2.5 | 64 864 | 1264 | 2.1 |
| ELD-CPD | CM18-Penetratin-Cys | Myoblasts | 5 | 65 636 | 3288 | 2.2 |

TABLE 2.11-continued

Monomers v. dimers CM18-TAT-Cys and CM18-Penetratin-Cys in primary myoblasts

| Domains | Peptide | Cells | Concentration (µM) | Mean counts | Stand. dev. | Mean Factor |
|---|---|---|---|---|---|---|
| ELD-CPD dimer | dCM18-Penetratin-Cys | Myoblasts | 2.5 | 71 547 | 10 975 | 2.4 |

The results in Table 2.11 suggest that shuttle peptide dimers are able to facilitate calcein endosomal escape levels that are comparable to the corresponding monomers in primary myoblasts.

Example 3

Peptide Shuttle Agents Increase GFP Transduction Efficiency 3.1 Protein Transduction Assay One day before the transduction assay was performed, cells in exponential growth phase were harvested and plated in a 96-well plate (20,000 cells per well). The cells were incubated overnight in appropriate growth media containing FBS (see Example 1). The next day, in separate sterile 1.5 mL tubes, cargo protein at the indicated concentration was pre-mixed (pre-incubated) for 1 or 10 min (depending on the protocol) at 37° C. with the peptide(s) to be tested shuttle agents (0.5 to 5 µM) in 50 µL of fresh medium without serum (unless otherwise specified). The media in wells was removed and the cells were washed three times with freshly prepared phosphate buffered saline (PBS) previously warmed at 37° C. The cells were incubated with the cargo protein/shuttle agent mixture at 37° C. for the indicated time (e.g., 1, 5 or 60 min). After the incubation, the cells were quickly washed three times with freshly prepared PBS and/or heparin (0.5 mg/mL) previously warmed at 37° C. The washes with heparin were required for human THP-1 blood cells to avoid undesired cell membrane-bound protein background in subsequent analyses (microscopy and flow cytometry). The cells were finally incubated in 50 µL of fresh medium with serum at 37° C. before analysis.

3.1a Protocol A: Protein Transduction Assay for Adherent Cells

One day before the transduction assay was performed, cells in exponential growth phase were harvested and plated in a 96-well plate (20,000 cells per well). The cells were incubated overnight in appropriate growth media containing serum (see Example 1). The next day, in separate sterile 1.5-mL tubes, peptides were diluted in sterile distilled water at room temperature (if the cargo is or comprised a nucleic acid, nuclease-free water was used). Cargo protein(s) were then added to the peptides and, if necessary, sterile PBS or cell culture medium (serum-free) was added to obtain the desired concentrations of shuttle agent and cargo in a sufficient final volume to cover the cells (e.g., 10 to 100 µL per well for a 96-well plate). The peptides/cargo mixture was then immediately used for experiments. At least three controls were included for each experiment, including: (1) peptides alone (e.g., at highest concentration tested); (2) cargo alone; and (3) without any cargo or shuttle agent. The media in wells was removed, cells were washed once with PBS previously warmed at 37° C., and the cells were incubated with the cargo protein/peptide mixture at 37° C. for the desired length of time. The peptide/cargo mixture in wells was removed, the cells were washed once with PBS, and fresh complete medium was added. Before analysis, the cells were washed once with PBS one last time and fresh complete medium was added.

3.1b Protocol B: Protein Transduction Assay for Suspension Cells

One day before the transduction assay was performed, suspension cells in exponential growth phase were harvested and plated in a 96-well plate (20,000 cells per well). The cells were incubated overnight in appropriate growth media containing serum (see Example 1). The next day, in separate sterile 1.5-mL tubes, peptides were diluted in sterile distilled water at room temperature (if the cargo is or comprised a nucleic acid, nuclease-free water was used). Cargo protein(s) were then added to the peptides and, if necessary, sterile PBS or cell culture medium (serum-free) was added to obtain the desired concentrations of shuttle agent and cargo in a sufficient final volume to resuspend the cells (e.g., 10 to 100 µL per well in a 96-well plate). The shuttle agent/peptide was then immediately used for experiments. At least three controls were included for each experiment, including: (1) peptide alone (e.g., at highest concentration tested); (2) cargo alone; and (3) without any cargo or shuttle agent. The cells were centrifuged for 2 minutes at 400g, the medium was then removed and the cells were resuspended in PBS previously warmed at 37° C. The cells were centrifuged again 2 minutes at 400g, the PBS removed, and the cells were resuspended with the cargo protein/peptide mixture at 37° C. for the desired length of time. After that, 200 µL of complete medium was added directly on the cells. Cells were centrifuged for 2 minutes at 400g and the medium was removed. The pellet was resuspended and washed in 200 µL of PBS previously warmed at 37° C. After another centrifugation, the PBS was removed and the cells were resuspended in 50 µL of trypsin-EDTA solution for 2 min. 200 of complete medium was directly added and cells were centrifuged for 2 minutes at 400g. The medium was removed and the cells were resuspended in 200 µL of complete medium.

3.2 Fluorescence Microscopy Analysis

The delivery of fluorescent protein cargo in cytosolic and nuclear cell compartments was observed with an Olympus IX70™ microscope (Japan) equipped with a fluorescence lamp (Model U-LH100HGAPO) and different filters. The Olympus filter U-MF2™ (C54942-Exc495/Em510) was used to observe GFP and FITC-labeled antibody fluorescent signals. The Olympus filter HQ-TR™ (V-N41004-Exc555-60/Em645-75) was used to observe mCherry™ and GFP antibody fluorescent signals. The Olympus filter U-MWU2™ (Exc330/Em385) was used to observe DAPI or Blue Hoechst fluorescent signals. The cells incubated in 50 µL of fresh medium were directly observed by microscopy (Bright-field and fluorescence) at different power fields (4× to 40×). The cells were observed using a CoolSNAP-PRO™ camera (Series A02D874021) and images were acquired using the Image-Proplus™ software.

3.2a Cell Immuno-Labelling

Adherent cells were plated on a sterile glass strip at 1.5×10⁵ cells per well in a 24-plate well and incubated overnight at 37° C. For fixation, cells were incubated in 500 µL per well of formaldehyde (3.7% v/v) for 15 minutes at room temperature, and washed 3 times for 5 minutes with PBS. For permeabilization, cells were incubated in 500 µL per well of Triton™ X-100 (0.2%) for 10 minutes at room temperature, and washed 3 times for 5 minutes with PBS. For blocking, cells were incubated in 500 µL per well of PBS containing 1% BSA (PBS/BSA) for 60 minutes at room temperature. Primary mouse monoclonal antibody was diluted PBS/BSA (1%). Cells were incubated in 30 μL of primary antibody overnight at 4° C. Cells were washed 3 times for 5 minutes with PBS. Secondary antibody was diluted in PBS/BSA (1%) and cells were incubated in 250 μL of secondary antibody 30 minutes at room temperature in the dark. Cells were washed 3 times for 5 minutes with PBS. Glass strips containing the cells were mounted on microscope glass slides with 10 μL of the mounting medium Fluoroshield™ with DAPI.

3.3 Flow Cytometry Analysis:

The fluorescence of GFP was quantified using flow cytometry (Accuri C6, Becton, Dickinson and Company (BD)). Untreated cells were used to establish a baseline in order to quantify the increased fluorescence due to the internalization of the fluorescent protein in treated cells. The percentage of cells with a fluorescence signal above the maximum fluorescence of untreated cells, "mean %" or "Pos cells (%)", is used to identify positive fluorescent cells. "Relative fluorescence intensity (FL1–A)" corresponds to the mean of all fluorescence intensities from each cell with a fluorescent signal after fluorescent protein delivery with the shuttle agent. Also, the events scanned by flow cytometry corresponding to cells (size and granularity) were analyzed. The cellular toxicity (% cell viability) was monitored comparing the percentage of cells in the total events scanned of treated cells comparatively to untreated cells.

3.3a Viability Analysis

Where indicated, the viability of cells was assessed with a resazurin test. Resazurin is a sodium salt colorant that is converted from blue to pink by mitochondrial enzymes in metabolically active cells. This colorimetric conversion, which only occurs in viable cells, can be measured by spectroscopy analysis in order to quantify the percentage of viable cells. The stock solution of resazurin was prepared in water at 1 mg/100 mL and stored at 4° C. 25 μL of the stock solution was added to each well of a 96-well plate, and cells were incubated at 37° C. for one hour before spectrometry analysis. The incubation time used for the resazurin enzymatic reaction depended on the quantity of cells and the volume of medium used in the wells.

3.4 Construction and Amino Acid Sequence of GFP

The GFP-encoding gene was cloned in a T5 bacterial expression vector to express a GFP protein containing a 6× histidine tag and a serine/glycine rich linker in the N-terminal end, and a serine/glycine rich linker and a stop codon (–) at the C-terminal end. Recombinant GFP protein was purified as described in Example 1.4. The sequence of the GFP construct was:

[SEQ ID NO: 60]
MHHHHHHGGGGSGGGGSGGASTGTGIR<u>MVSKGEELFTGVVPILVELDGDVN

GHKFSVSGEGEGDATYGKLTLKFICTTGKLPVPWPTLVTTLTYGVQCFSRY

PDHMKQHDFFKSAMPEGYVQERTIFFKDDGNYKTRAEVKFEGDTLVNRIEL

KGIDFKEDGNILGHKLEYNYNSHNVYIMADKQKNGIKVNFKIRHNIEDGSV

QLADHYQQNTPIGDGPVLLPDNHYLSTQSALSKDPNEKRDHMVLLEFVTAA

Figure 5:
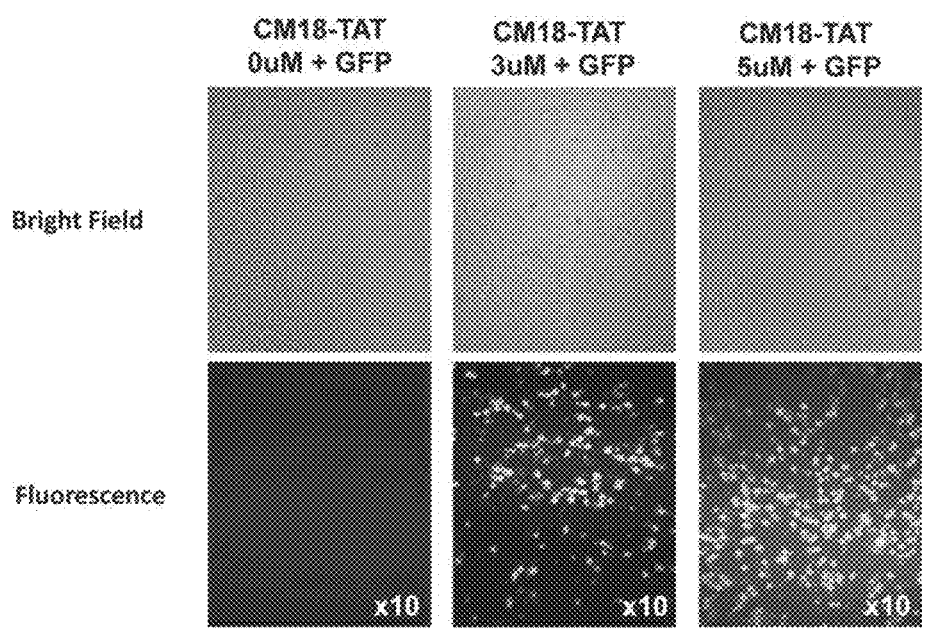
FIG. 5 shows the results of a GFP transduction experiment visualized by fluorescence microscopy in which a GFP cargo protein was co-incubated with 0, 3 or 5 μM of CM18-TAT-Cys (labeled "CM18-TAT"), and then exposed to HeLa cells. The cells were observed by bright field (upper panels) and fluorescence microscopy (lower panels).

GITLGMDELYK</u>GGSGGGSGGGSGWIRASSGGREIS-
(MW = 31.46 kDa; pI = 6.19)
Serine/glycine rich linkers are in bold
GFP sequence is underlined 3.5 GFP Transduction by CM18-TAT-Cys in HeLa Cells: Fluorescence Microscopy HeLa cells were cultured and tested in the protein transduction assay described in Example 3.1. Briefly, GFP recombinant protein was co-incubated with 0, 3 or 5 μM of CM18-TAT, and then exposed to HeLa cells for 1 hour. The cells were observed by bright field and fluorescence microscopy as described in Example 3.2. The results presented in FIG. 5 show that GFP was delivered intracellularly to HeLa cells in the presence of the shuttle agent CM18-TAT.

3.6 GFP Transduction by Shuttle Agents in HeLa Cells: Dose Responses (CM18-TAT-Cys, dCM18-TAT-Cys, GFP) and Cell Viability HeLa cells were cultured and tested in the protein transduction assay described in Examples 3.1-3.3. Briefly, GFP recombinant protein was co-incubated with different concentrations of CM18-TAT-Cys or dimerized CM18-TAT-Cys (dCM18-TAT-Cys), and then exposed to HeLa cells for 1 hour. The results are shown in Table 3.1 and FIGS. 6A-6B.

TABLE 3.1

Figure 6A:
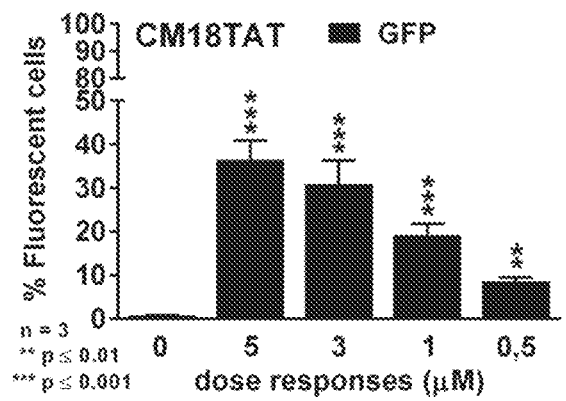
FIGS. 6A and 6B show the results of a GFP transduction efficiency experiment in which GFP cargo protein (10 μM) was co-incubated with different concentrations of CM18-TAT-Cys (labeled "CM18-TAT"), prior to being exposed to HeLa cells. Cells were evaluated by flow cytometry and the percentage of fluorescent (GFP-positive) cell is shown in FIG. 6A, and corresponding cell toxicity data is shown in FIG. 6B.
Figure 6B:
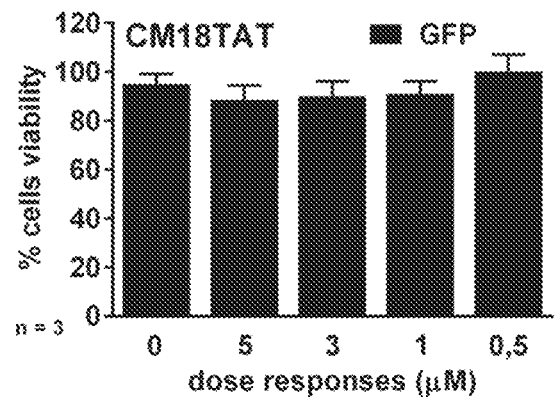

Dose response (CM18-TAT) and cell viability, data from FIGS. 6A and 6B

| | | | FIG. 6A | | FIG. 6B Cell viability |
|---|---|---|---|---|---|
| Shuttle | Cells | Concentration (μM) | Mean (%) (n = 3) | Standard deviation | (%) (±St. Dev.; n = 3) |
| CM18-TAT-Cys | HeLa | 0 | 0.69 | 0.12 | 95 ± 4 |
| | HeLa | 0.5 | 8.67 | 0.96 | 88.4 ± 6 |
| | HeLa | 1 | 20.03 | 2.55 | 90 ± 6 |
| | HeLa | 3 | 31.06 | 5.28 | 91 ± 5 |
| | HeLa | 5 | 36.91 | 4.33 | 90 ± 7 |

Table 3.1 and FIG. 6A show the results of flow cytometry analysis of the fluorescence intensity of HeLa cells transduced with GFP (5 μM) without or with 5, 3, 1, and 0.5 μM of CM18-TAT-Cys. Corresponding cellular toxicity data are presented in Table 3.1 and in FIG. 6B. These results suggest that the shuttle agent CM18-TAT-Cys increases the transduction efficiency of GFP in a dose-dependent manner.

TABLE 3.2

Figure 7A:
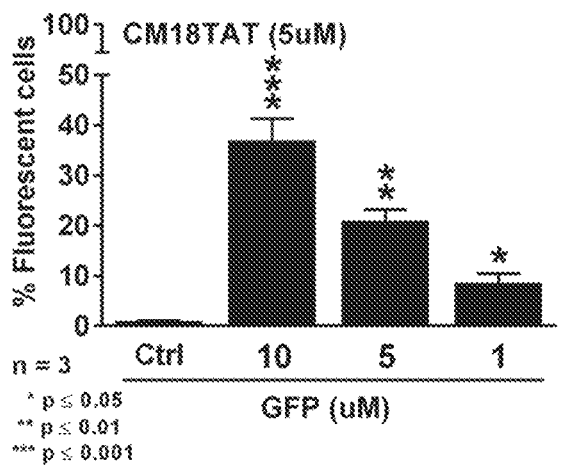
FIGS. 7A and 7B shows the results of a GFP transduction efficiency experiment in which different concentrations of GFP cargo protein (10, 5 or 1 μM) were co-incubated with either 5 μM of CM18-TAT-Cys (FIG. 7A, labeled "CM18TAT"), or 2.5 μM of dCM18-TAT-Cys (FIG. 7B, labeled "dCM18TAT"), prior to being exposed to HeLa cells. Cells were evaluated by flow cytometry and the percentages of fluorescent (GFP-positive) cells are shown.
Figure 7B:
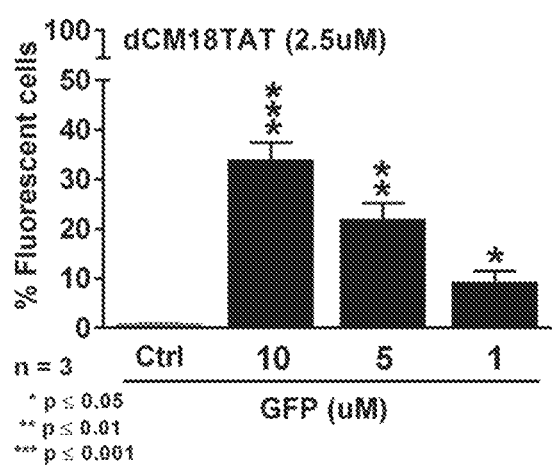

Dose response (GFP), data from FIGS. 7A and 7B

| Shuttle | Cells | Conc. of shuttle agent (μM) | Conc. of GFP (μM) | Mean (%) (n = 3) | Standard deviation |
|---|---|---|---|---|---|
| Control | HeLa | 0 | 10 | 0.93 | 0.08 |
| CM18-TAT-Cys | HeLa | 5 | 10 | 37.1 | 4.29 |
| | HeLa | 5 | 5 | 21.1 | 2.19 |
| | HeLa | 5 | 1 | 8.56 | 1.91 |
| Control | HeLa | 0 | 10 | 0.91 | 0.09 |
| dCM18-TAT-Cys | HeLa | 2.5 | 10 | 34.2 | 3.42 |
| | HeLa | 2.5 | 5 | 22.2 | 3.17 |
| | HeLa | 2.5 | 1 | 9.38 | 2.11 |

Table 3.2 and FIG. 7 show the results of flow cytometry analysis of the fluorescence intensity of HeLa cells transduced with different concentrations of GFP (1 to 10 μM) without or with 5 μM of CM18-TAT-Cys (FIG. 7A) or 2.5 μM dCM18-TAT-Cys (FIG. 7B).

3.7 GFPC Transduction in HeLa Cells: Dose Responses of CM18-TAT-Cys and CM-Penetratin-Cys, and Dimers Thereof HeLa cells were cultured and tested in the protein transduction assay described in Example 3.1. Briefly, GP recombinant protein (5 μM) was co-incubated with different concentrations and combinations of CM18-TAT-Cys, CM18-Penetratin-Cys, and dimers of each (dCM18-TAT-Cys, dCM18-Penetratin-Cys), and then exposed to HeLa cells for 1 hour. The cells were subjected to flow cytometry analysis as described in Example 3.3. The results are shown in Table 3.3 and FIG. 8, as well as in Table 3.4 and FIG. 9.

TABLE 3.3

Figure 8:
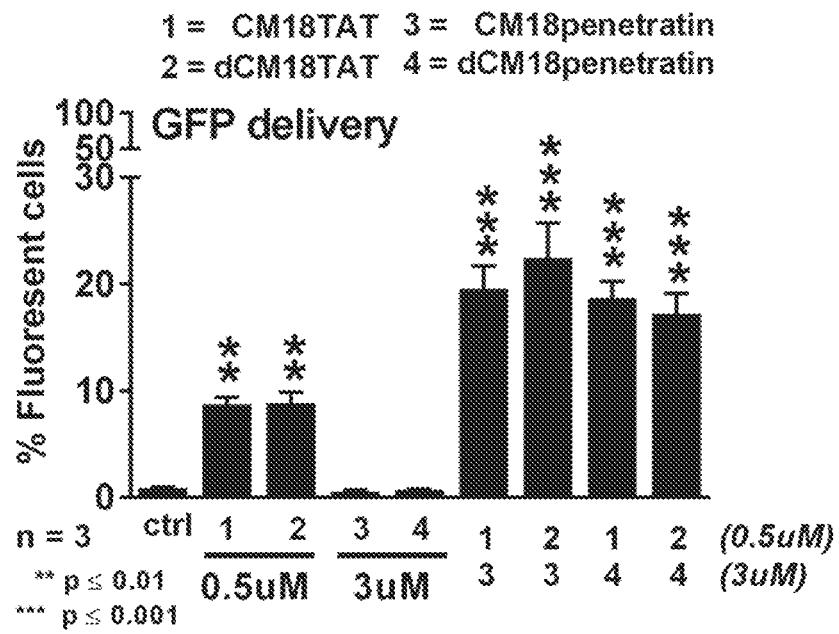
FIGS. 8 and 9 show the results of GFP transduction efficiency experiments in which GFP cargo protein (10 μM) was co-incubated with different concentrations and combinations of CM18-TAT-Cys (labeled "CM18TAT"), CM18-Penetratin-Cys (labeled "CM18penetratin"), and dimers of each (dCM18-TAT-Cys (labeled "dCM18TAT"), dCM18-Penetratin-Cys (labeled "dCM18penetratin"), prior to being exposed to HeLa cells. Cells were evaluated by flow cytometry and the percentages of fluorescent (GFP-positive) cells are shown.

Data in FIG. 8

| No. in FIG. 8 | Shuttle agent | Cells | Concentration (μM) | Mean (%) (n = 3) | Standard deviation |
|---|---|---|---|---|---|
| Control ("ctrl") | No shuttle | HeLa | 0 | 0.43 | 0.08 |
| 1 | CM18-TAT-Cys | HeLa | 0.5 | 8.75 | 0.63 |
| 2 | dCM18-TAT-Cys | HeLa | 0.5 | 8.86 | 1.03 |
| 3 | CM18-Penetratin-Cys | HeLa | 3 | 0.59 | 0.11 |
| 4 | dCM18-Penetratin-Cys | HeLa | 3 | 0.73 | 0.08 |
| 1 + 3 | CM18-TAT-Cys + CM18Penetratin-Cys | HeLa | 0.5 3 | 19.52 | 2.18 |
| 2 + 3 | dCM18-TAT-Cys + CM18-Penetratin-Cys | HeLa | 0.5 3 | 22.44 | 3.29 |
| 1 + 4 | CM18-TAT-Cys + dCM18-Penetratin-Cys | HeLa | 0.5 3 | 18.73 | 1.55 |
| 2 + 4 | dCM18-TAT-Cys + dCM18-Penetratin-Cys | HeLa | 0.5 3 | 17.19 | 1.93 |

The results in Table 3.3 and FIG. 8 show that the transduction efficiency of GFP is increased in HeLa cells using the shuttle agents CM18-TAT-Cys and dCM18-TAT-Cys (see bars "1" and "2" in FIG. 8). Although no GFP intracellular delivery was observed using CM18-Penetratin-Cys or dCM18-Penetratin-Cys alone (see bars "3" or "4" in FIG. 8), combination of CM18-TAT-Cys with CM18-Penetratin-Cys (monomer or dimer) improved GFP protein delivery (see four right-most bars in FIG. 8).

TABLE 3.4

Figure 9:
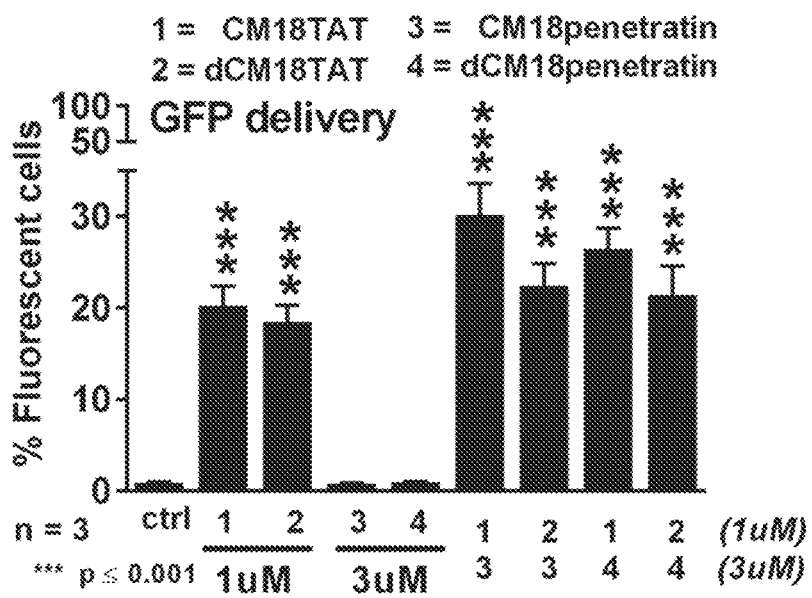

Data in FIG. 9

| No. in FIG. 9 | Shuttle | Cells | Concentration (μM) | Mean (%) (n = 3) | Standard deviation |
|---|---|---|---|---|---|
| Control ("ctrl") | No shuttle | HeLa | 0 | 0.51 | 0.07 |
| 1 | CM18-TAT-Cys | HeLa | 1 | 20.19 | 2.19 |
| 2 | dCM18-TAT-Cys | HeLa | 1 | 18.43 | 1.89 |
| 3 | CM18-Penetratin-Cys | HeLa | 3 | 0.81 | 0.07 |
| 4 | dCM18-Penetratin-Cys | HeLa | 3 | 0.92 | 0.08 |
| 1 + 3 | CM18-TAT-Cys + CM18-Penetratin-Cys | HeLa | 1 3 | 30.19 | 3.44 |
| 2 + 3 | dCM18-TAT-Cys + CM18-Penetratin-Cys | HeLa | 1 3 | 22.36 | 2.46 |
| 1 + 4 | CM18-TAT-Cys + dCM18-Penetratin-Cys | HeLa | 1 3 | 26.47 | 2.25 |
| 2 + 4 | dCM18-TAT-Cys + dCM18-Penetratin-Cys | HeLa | 1 3 | 21.44 | 3.11 |

The results in Table 3.4 and FIG. 9 show that the transduction efficiency of GFP is increased in HeLa cells using the shuttle agents CM18-TAT-Cys and dCM18-TAT-Cys (see bars "1" and "2" in FIG. 9). Although no GFP intracellular delivery was observed using CM18-Penetratin-Cys or dCM18-Penetratin-Cys alone (see bars "3" or "4" in FIG. 9), combination of CM18-TAT-Cys with CM18-Penetratin-Cys (monomer or dimer) improved GFP protein delivery (see four right-most bars in FIG. 9).

3.8 GFP Transduction by Shuttle Agents in HeLa Cells: Controls

HeLa cells were cultured and tested in the protein transduction assay described in Example 3.1. Briefly, GFP recombinant protein (5 µM) was co-incubated with 5 µM of each of the following peptide(s): TAT-Cys; CM18; Penetratin-Cys; TAT-Cys+CM18; Penetratin-Cys+CM18; and CM18-TAT-Cys, and then exposed to HeLa cells for 1 hour. GFP fluorescence was visualized by bright field and fluorescence microscopy. The microscopy results (data not shown) showed that GFP was successfully delivered intracellularly using CM18-TAT-Cys. However, GFP was not successfully delivered intracellularly using single-domain peptides used alone (CM18, TAT-Cys, Penetratin-Cys) or together (CM18+TAT-Cys, CM18+Penetratin-Cys). These results are consistent with those presented in Tables 2.1 and 2.2 with respect to the calcein endosome escape assays.

Example 4

Peptide Shuttle Agents Increase TAT-GFP Transduction Efficiency

The experiments in Example 3 showed the ability of shuttle agents to deliver GFP intracellularly. The experiments presented in this example show that the shuttle agents can also increase the intracellular delivery of a GFP cargo protein that is fused to a CPD (TAT-GFP).

4.1 Construction and Amino Acid Sequence of TAT-GFP

Construction was performed as described in Example 3.4, except that a TAT sequence was cloned between the 6× histidine tag and the GFP sequences. The 6× histidine tag, TAT, GFP and a stop codon (−) are separated by serine/glycine rich linkers. The recombinant TAT-GFP protein was purified as described in Example 1.4. The sequence of the TAT-GFP construct was:

```
                                           SEQ ID NO: 61]
MHHHHHHGGGGSGGGGSGGASTGTGRKKRRQRRRPPQGGGGSGGGGSGGGT

GIRMVSKGEELFTGVVPILVELDGDVNGHKFSVSGEGEGDATYGKLTLKFI

CTTGKLPVPWPTLVTTLTYGVQCFSRYPDHMKQHDFFKSAMPEGYVQERTI

FFKDDGNYKTRAEVKFEGDTLVNRIELKGIDFKEDGNILGHKLEYNYNSHN

VYIMADKQNGIKVNFKIRHNIEDGSVQLADHYQQNTPIGDGPVLLPDNHYL

STQSALSKDPNEKRDHMVLLEFVTAAGITLGMDELYKGGSGGGSGGGSGWI

RASSGGREIS-
(MW = 34.06 kDa; pI = 8.36)
TAT sequence is underlined
Serine/glycine rich linkers are in bold
```

Figure 10:
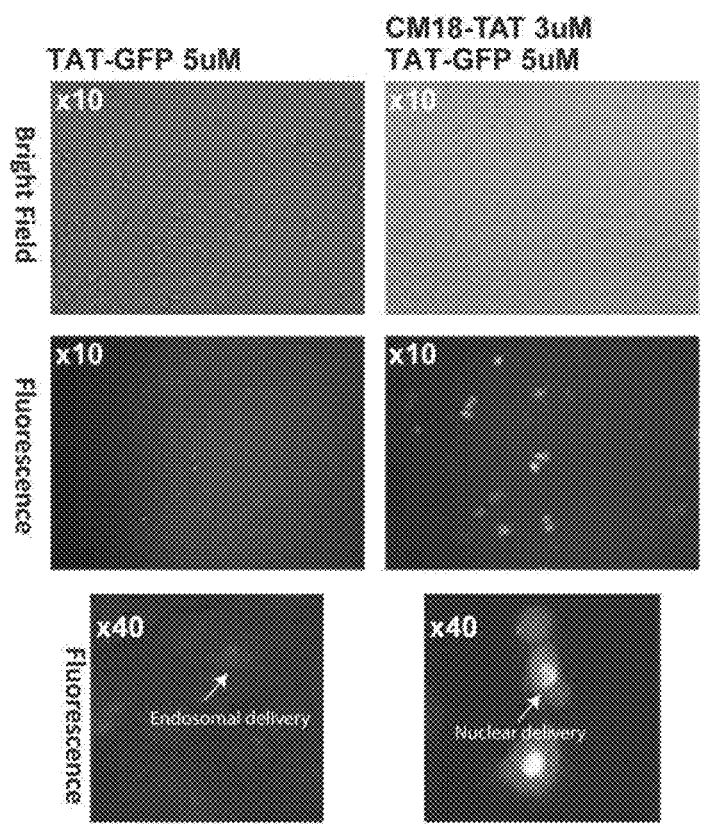
FIG. 10 shows typical results of a TAT-GFP transduction experiment in which TAT-GFP cargo protein (5 μM) was co-incubated with 3 μM of CM18-TAT-Cys (labeled "CM18-TAT"), prior to being exposed to HeLa cells. Cells and GFP fluorescence were visualized by bright field and fluorescence microscopy at 10× and 40× magnifications. Arrows indicate the endosome delivery of TAT-GFP in the absence of CM18-TAT-Cys, as well as its nuclear delivery in the presence of CM18-TAT-Cys.

4.2 TAT-GFP Transduction by CM18-TAT-Cys in HeLa Cells: Visualisation by Fluorescence Microscopy HeLa cells were cultured and tested in the protein transduction assay described in Example 3.1. Briefly, TAT-GFP recombinant protein (5 µM) was co-incubated with 3 µM of CM18-TAT-Cys and then exposed to HeLa cells for 1 hour. Cells and GFP fluorescence were visualized by bright field and fluorescence microscopy (as described in Example 3.2) at 10× and 40× magnifications, and sample results are shown in FIG. 10. The microscopy results revealed that in the absence of CM18-TAT-Cys, TAT-GFP shows a low intensity, endosomal distribution as reported in the literature. In contrast, TAT-GFP is delivered to the cytoplasm and to the nucleus in the presence of the shuttle agent CM18-TAT-Cys. Without being bound by theory, the TAT peptide itself may act as a nuclear localization signal (NLS), explaining the nuclear localization of TAT-GFP. These results show that CM18-TAT-Cys is able to increase TAT-GFP transduction efficiency and allow endosomally-trapped TAT-GFP to gain access to the cytoplasmic and nuclear compartments.

4.3 TAT-GFP Transduction by CM18-TAT-Cys in HeLa Cells: Dose Responses and Viability of Cells Transduced HeLa cells were cultured and tested in the protein transduction assay described in Example 3.1. Briefly, TAT-GFP recombinant protein (5 µM) was co-incubated with different concentrations of CM18-TAT-Cys (0, 0.5, 1, 3, or 5 µM) and then exposed to HeLa cells for 1 hour. The cells were subjected to flow cytometry analysis as described in Example 3.3. Results are shown in Table 4.3 and FIG. 11A. Corresponding cellular toxicity data are presented in FIG. 11B.

TABLE 4.3

Figure 11A:
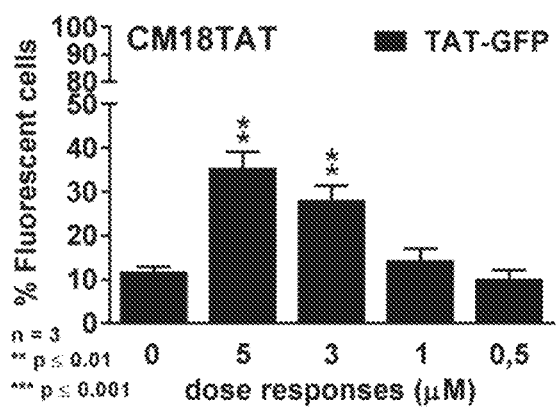
FIGS. 11A and 11B show the results of a TAT-GFP transduction efficiency experiment in which TAT-GFP cargo protein (5 μM) was co-incubated with different concentrations of CM18-TAT-Cys (labeled "CM18TAT"), prior to being exposed to HeLa cells. Cells were evaluated by flow cytometry and the percentage of fluorescent (GFP-positive) cell is shown in FIG. 11A, and corresponding cell toxicity data is shown in FIG. 11B.
Figure 11B:
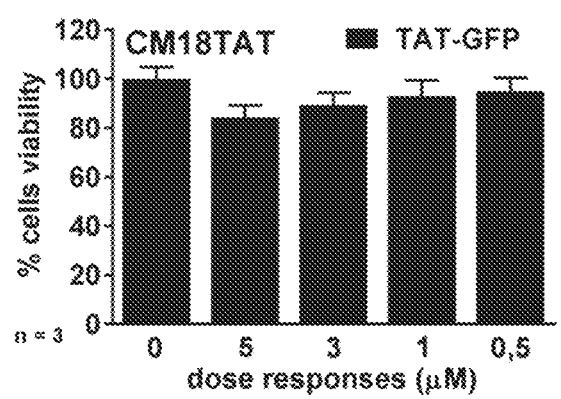

Data from FIG. 11A and 11B

| Shuttle agent | Cells | Concentration (µM) | FIG. 11A Mean (%) (n = 3) | Standard deviation | FIG. 11B Cell viability (%) (±St. Dev.; n = 3) |
|---|---|---|---|---|---|
| CM18-TAT-Cys | HeLa | 0 | 11.79[1] | 1.16 | 100 |
|  | HeLa | 0.5 | 10.19 | 1.94 | 84.36 ± 5 |
|  | HeLa | 1 | 14.46 | 2.59 | 89.26 ± 5.26 |
|  | HeLa | 3 | 28.12 | 3.27 | 93.18 ± 6.28 |
|  | HeLa | 5 | 35.5[2] | 3.59 | 95.14 ± 5.28 |

[1]The fluorescence was mostly endosomal, as confirmed by fluorescence microscopy.
[2]Fluorescence was more diffuse and also nuclear, as confirmed by fluorescence microscopy.

Example 5

Peptide Shuttle Agents Increase GFP-NLS Transduction Efficiency and Nuclear Localization The experiments in Examples 3 and 4 showed the ability of shuttle agents to deliver GFP and TAT-GFP intracellularly. The experiments presented in this example show that the shuttle agents can facilitate nuclear delivery of a GFP protein cargo fused to a nuclear localization signal (NLS).

5.1 Construction and Amino Acid Sequence of GFP-NLS

Construction was performed as described in Example 3.4, except that an optimized NLS sequence was cloned between the GFP sequence and the stop codon (−). The NLS sequence is separated from the GFP sequence and the stop codon by two serine/glycine rich linkers. The recombinant GFP-NLS protein was purified as described in Example 1.4. The sequence of the GFP-NLS construct was: IDC-49 DNA

[SEQ ID NO: 62]
MHHHHHHGGGGSGGGGSGGASTGIRMVSKGEELFTGVVPILVELDGDVNGH

KFSVSGEGEGDATYGKLTLKFICTTGKLPVPWPTLVTTLTYGVQCFSRYPD

HMKQHDFFKSAMPEGYVQERTIFFKDDGNYKTRAEVKFEGDTLVNRIELKG

IDFKEDGNILGHKLEYNYNSHNVYIMADKQKNGIKVNFKIRHNIEDGSVQL

ADHYQQNTPIGDGPVLLPDNHYLSTQSALSKDPNEKRDHMVLLEFVTAAGI

TLGMDELYKGGSGGGSGGGSGWIRASSGGRSSDDEATADSQHAAPPKKKRK

Figure 12:
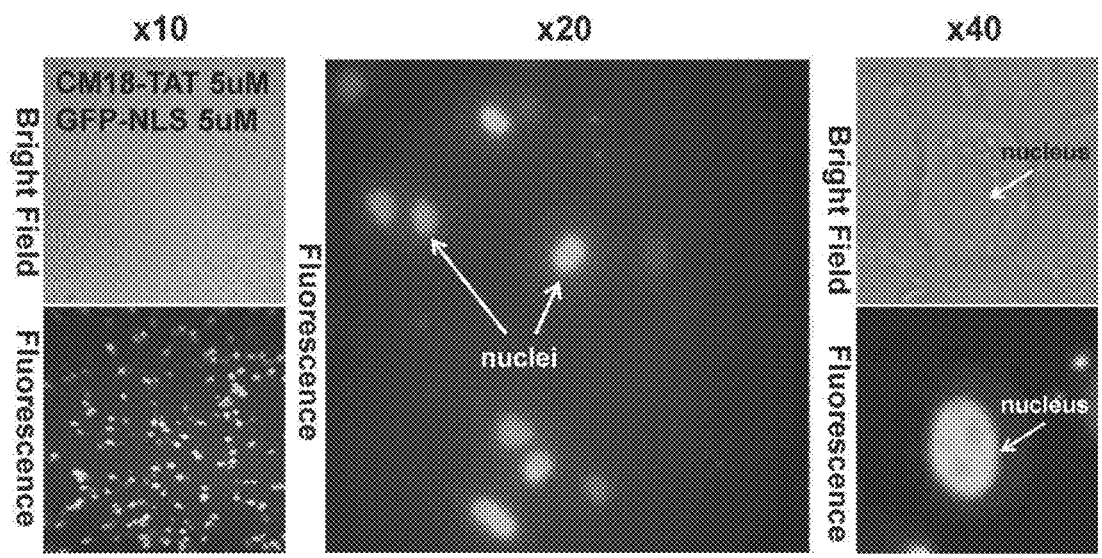
FIG. 12 shows typical results of a GFP-NLS transduction experiment in which GFP-NLS cargo protein (5 μM) was co-incubated with 5 μM of CM18-TAT-Cys (labeled "CM18-TAT"), prior to being exposed to HeLa cells for 5 minutes. Cells and GFP fluorescence were visualized by bright field and fluorescence microscopy at 10×, 20×, and 40× magnifications. Arrows indicate areas of nuclear delivery of GFP-NLS.

VGGSGGGSGGGSGGGRGTEIS-
(MW = 34.85 kDa; pI = 6.46)
NLS sequence is underlined
Serine/glycine rich linkers are in bold 5.2 Nuclear Delivery of GFP-NLS by CM18-TAT-Cys in HeLa Cells in 5 Minutes: Visualisation by Fluorescence Microscopy HeLa cells were cultured and tested in the protein transduction assay described in Example 3.1. Briefly, GFP-NLS recombinant protein (5 µM) was co-incubated with 5 µM of CM18-TAT-Cys, and then exposed to HeLa cells. GFP fluorescence was visualized by bright field and fluorescence microscopy after 5 minutes (as described in Example 3.2) at 10×, 20× and 40× magnifications, and sample results are shown in FIG. 12. The microscopy results revealed that GFP-NLS is efficiently delivered to the nucleus in the presence of the shuttle agent CM18-TAT-Cys, after only 5 minutes of incubation.

5.3 GFP-NLS Transduction by CM18-TAT-Cys in HeLa Cells: Dose Responses and Viability of Cells Transduced HeLa cells were cultured and tested in the protein transduction assay described in Example 3.1. GFP-NLS recombinant protein (5 µM) was co-incubated with 0, 0.5, 1, 3, or 5 µM of CM18-TAT-Cys, and then exposed to HeLa cells for 1 hour. The cells were subjected to flow cytometry analysis as described in Example 3.3. Results are shown in Table 5.1 and FIG. 13A. Corresponding cellular toxicity data are presented in FIG. 13B.

TABLE 5.1

Figure 13A:
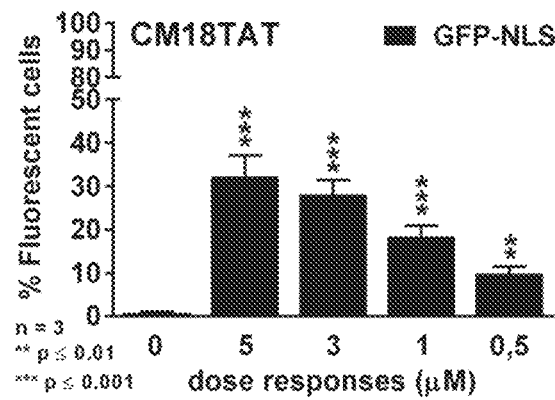
FIGS. 13A and 13B show the results of a GFP-NLS transduction efficiency experiment in which GFP-NLS cargo protein (5 μM) was co-incubated with different concentrations of CM18-TAT-Cys (labeled "CM18TAT"), prior to being exposed to HeLa cells. Cells were evaluated by flow cytometry and the percentage of fluorescent (GFP-positive) cell is shown in FIG. 13A, and corresponding cell toxicity data is shown in FIG. 13B.
Figure 13B:
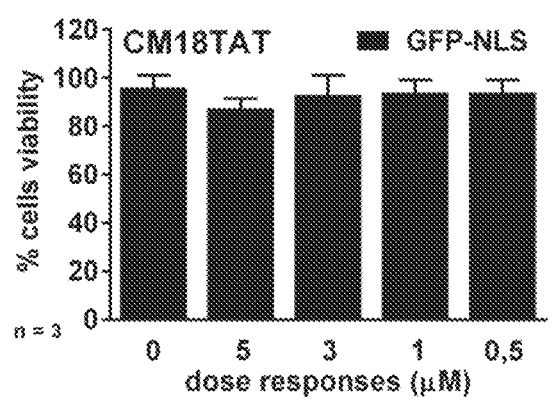

Data from FIGS. 13A and 13B

| | | | FIG. 13A | | FIG. 13B Cell viability |
|---|---|---|---|---|---|
| Shuttle agent | Cells | Concentration (µM) | Mean (%) (n = 3) | Standard deviation | (%) (±St Dev.; n = 3) |
| CM18-TAT-Cys | HeLa | 0 | 0.90 | 0.12 | 100 |
| | HeLa | 0.5 | 9.81 | 1.63 | 87.6 ± 4 |
| | HeLa | 1 | 18.42 | 2.47 | 93 ± 8 |
| | HeLa | 3 | 28.09 | 3.24 | 94 ± 5 |
| | HeLa | 5 | 32.26 | 4.79 | 93 ± 4 |

These results show that CM18-TAT-Cys is able to increase GFP-NLS transduction efficiency in HeLa cells in a dose-dependent manner.

5.4 GFP-NLS Transduction by CM18-TAT-Cys, CM18-Penetratin-Cys, and Dimers Thereof in HeLa Cells HeLa cells were cultured and tested in the protein transduction assay described in Example 3.1. GFP-NLS recombinant protein (5 µM) was co-incubated with different concentrations and combinations of CM18-TAT-Cys, CM18-Penetratin-Cys, and dimers of each (dCM18-TAT-Cys, dCM18-Penetratin-Cys), and then exposed to HeLa cells for 1 hour. The cells were subjected to flow cytometry analysis as described in Example 3.3. The results are shown in Tables 5.2 and 5.3, and in FIGS. 14 and 15.

TABLE 5.2

Figure 14:
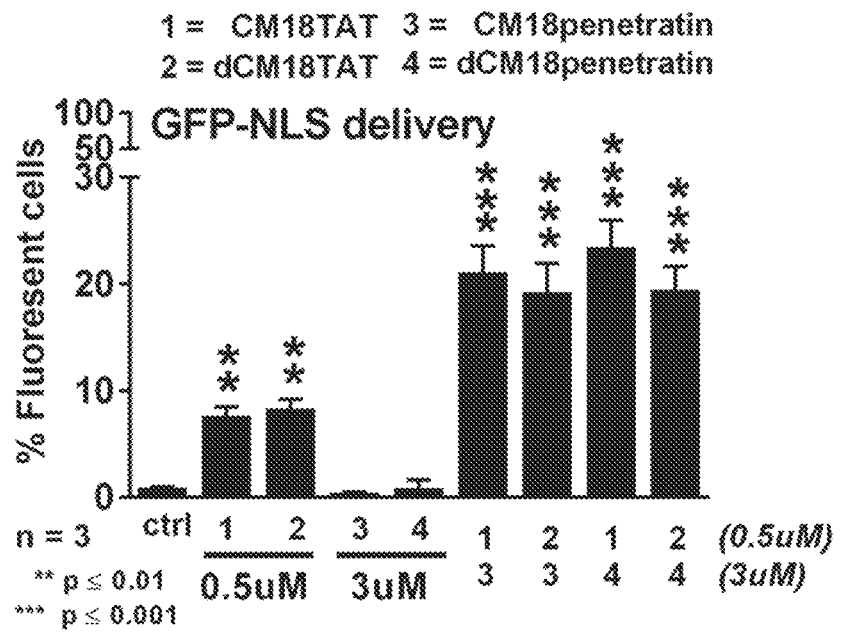
FIGS. 14 and 15 show the results of GFP-NLS transduction efficiency experiments in which GFP-NLS cargo protein (5 μM) was co-incubated with different concentrations and combinations of CM18-TAT (labeled "CM18TAT"), CM18-Penetratin (labeled "CM18penetratin"), and dimers of each (dCM18-TAT-Cys, dCM18-Penetratin-Cys; labeled "dCM18TAT" and "dCM18penetratin", respectively), prior to being exposed to HeLa cells. Cells were evaluated by flow cytometry and the percentages of fluorescent (GFP-positive) cells are shown.

Data in FIG. 14

| No. in FIG. 14 | Shuttle agent | Cells | Concentration (µM) | Mean (%) (n = 3) | Standard deviation |
|---|---|---|---|---|---|
| ctrl | No shuttle | HeLa | 0 | 0.41 | 0.10 |
| 1 | CM18-TAT-Cys | HeLa | 0.5 | 7.64 | 0.85 |
| 2 | dCM18-TAT-Cys | HeLa | 0.5 | 8.29 | 0.91 |
| 3 | CM18-Penetratin-Cys | HeLa | 3 | 0.43 | 0.08 |
| 4 | dCM18-Penetratin-Cys | HeLa | 3 | 0.85 | 0.07 |
| 1 + 3 | CM18-TAT-Cys + CM18-Penetratin-Cys | HeLa | 0.5 3 | 21.1 | 2.47 |
| 2 + 3 | dCM18-TAT-Cys + CM18-Penetratin-Cys | HeLa | 0.5 3 | 19.22 | 2.73 |
| 1 + 4 | CM18-TAT-Cys + dCM18-Penetratin-Cys | HeLa | 0.5 3 | 23.44 | 2.51 |
| 2 + 4 | dCM18-TAT-Cys + dCM18-Penetratin-Cys | HeLa | 0.5 3 | 19.47 | 2.16 |

TABLE 5.3

Figure 15:
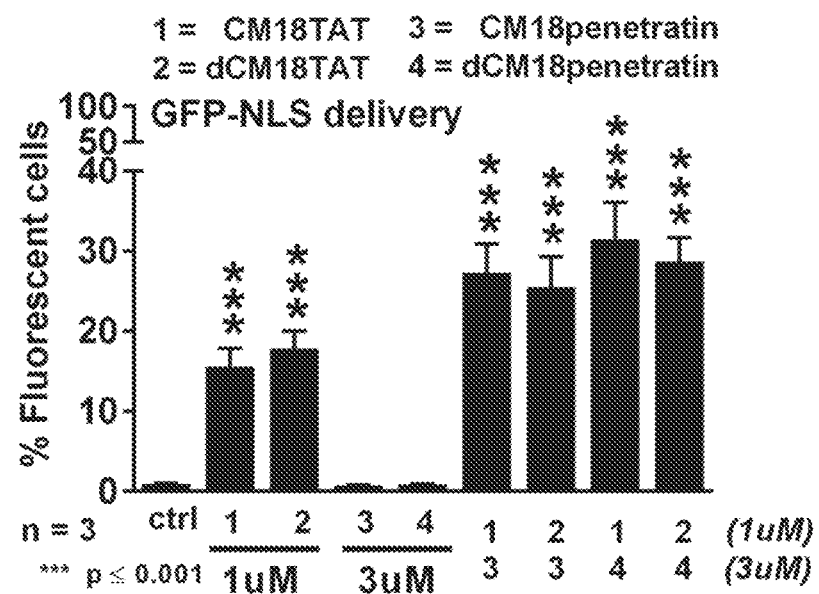

Data in FIG. 15

| No. in FIG. 15 | Shuttle agent | Cells | Concentration (µM) | Mean (%) (n = 3) | Standard deviation |
|---|---|---|---|---|---|
| ctrl | No shuttle | HeLa | 0 | 0.44 | 0.12 |
| 1 | CM18-TAT-Cys | HeLa | 1 | 15.56 | 2.24 |
| 2 | dCM18-TAT-Cys | HeLa | 1 | 17.83 | 2.13 |
| 3 | CM18-Penetratin-Cys | HeLa | 3 | 0.68 | 0.05 |
| 4 | dCM18-Penetratin-Cys | HeLa | 3 | 0.84 | 0.07 |
| 1 + 3 | CM18-TAT-Cys + CM18-Penetratin-Cys | HeLa | 1 3 | 27.26 | 3.61 |
| 2 + 3 | dCM18-TAT-Cys + CM18-Penetratin-Cys | HeLa | 1 3 | 25.47 | 3.77 |
| 1 + 4 | CM18-TAT-Cys + dCM18-Penetratin-Cys | HeLa | 1 3 | 31.47 | 4.59 |
| 2 + 4 | dCM18-TAT-Cys + dCM18-Penetratin-Cys | HeLa | 1 3 | 28.74 | 2.93 |

The results in Tables 5.2 and 5.3 and FIGS. 14 and 15 show that the transduction efficiency of GFP-NLS is increased in HeLa cells using the shuttle agents CM18-TAT-Cys and dCM18-TAT-Cys (see bars "1" and '2' in FIGS. 14 and 15). Although no GFP-NLS intracellular delivery was observed using CM18-Penetratin-Cys or dCM18-Penetratin-Cys alone (see bars "3" and "4" in FIGS. 14 and 15), combination of CM18-TAT-Cys with CM18-Penetratin-Cys (monomer or dimer) improved GFP-NLS intracellular delivery (see four right-most bars in FIGS. 14 and 15).

5.5 GFP-NLS Transduction by Shuttle Agents in HeLa Cells: 5 Min v. 1 h Incubation; with or without FBS HeLa cells were cultured and tested in the protein transduction assay described in Example 3.1. GFP-NLS recombinant protein (5 µM) was co-incubated with either CM18-

TAT-Cys (3.5 μM) alone or with dCM18-Penetratin-Cys (1 μM). Cells were incubated for 5 minutes or 1 hour in plain DMEM media ("DMEM") or DMEM media containing 10% FBS ("FBS"), before being subjected to flow cytometry analysis as described in Example 3.3. The results are shown in Table 5.4, and in FIG. 16. Cells that were not treated with shuttle agent or GFP-NLS ("ctrl"), and cells that were treated with GFP-NLS without shuttle agent ("GFP-NLS 5 μM") were used as controls.

TABLE 5.4

Figure 16:
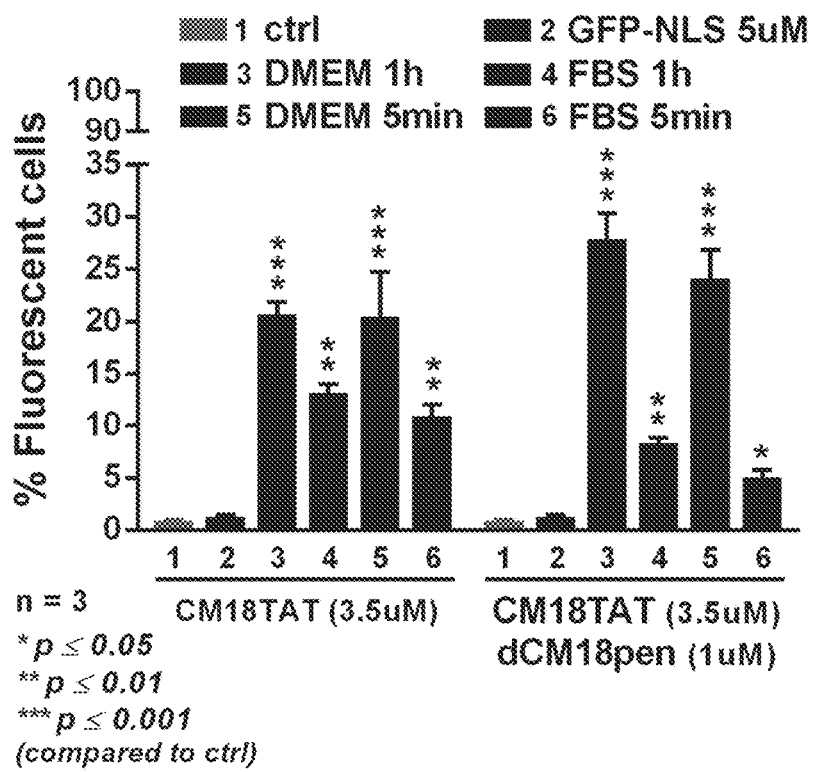
FIG. 16 shows the results of a GFP-NLS transduction efficiency experiment in which GFP-NLS cargo protein (5 μM) was co-incubated with either CM18-TAT-Cys (3.5 μM, labeled "CM18TAT") alone or with dCM18-Penetratin-Cys (1 μM, labeled "dCM18pen") for 5 minutes or 1 hour in plain DMEM media ("DMEM") or DMEM media containing 10% FBS ("FBS"), before being subjected to flow cytometry analysis. The percentages of fluorescent (GFP-positive) cells are shown. Cells that were not treated with shuttle agent or GFP-NLS ("ctrl"), and cells that were treated with GFP-NLS without shuttle agent ("GFP-NLS 5 μM") were used as controls.

Data in FIG. 16

| Shuttle | No. in FIG. 16 | Cells | Medium | Incubation time | Shuttle Conc. (μM) | Mean (%) (n = 3) | Standard deviation |
|---|---|---|---|---|---|---|---|
| No shuttle (Ctrl) | 1 | HeLa | DMEM | 1 h | 0 | 0.59 | 0.09 |
| GFP-NLS alone | 2 | HeLa | DMEM | 1 h | 0 | 1.19 | 0.31 |
| CM18-TAT-Cys | 3 | HeLa | DMEM | 1 h | 3.5 | 20.69 | 1.19 |
|  | 4 | HeLa | FBS | 1 h | 3.5 | 13.20 | 0.82 |
| CM18-TAT-Cys | 5 | HeLa | DMEM | 5 min | 3.5 | 20.45 | 4.26 |
|  | 6 | HeLa | FBS | 5 min | 3.5 | 10.83 | 1.25 |
| No shuttle (Ctrl) | 1 | HeLa | DMEM | 1 h | 0 | 0.53 | 0.11 |
| GFP-NLS alone | 2 | HeLa | DMEM | 1 h | 0 | 1.25 | 0.40 |
| CM18-TAT-Cys + dCM18-Penetratin-Cys | 3 | HeLa | DMEM | 1 h | 3.51 | 27.90 | 2.42 |
|  | 4 | HeLa | FBS | 1 h | 3.51 | 8.35 | 0.46 |
| CM18-TAT-Cys + dCM18-Penetratin-Cys | 5 | HeLa | DMEM | 5 min | 3.51 | 24.10 | 2.76 |
|  | 6 | HeLa | FBS | 5 min | 3.51 | 5.02 | 0.72 |

The results in Table 5.4 and FIG. 16 show that the addition of even a relatively low amount of the dimer dCM18-Penetratin-Cys (1 μM; "dCM18pen") to the CM18-TAT-Cys monomer improved GFP-NLS transduction efficiency. Interestingly, intracellular GFP-NLS delivery was achieved in as little as 5 minutes of incubation, and delivery was still achievable (although reduced) in the presence of FBS.

5.6 GFP-NLS Transduction by Shuttle Agents in THP-1 Suspension Cells

The ability of the shuttle agents to deliver GFP-NLS intracellularly was tested in THP-1 cells, which is an acute monocytic leukemia cell line that grows in suspension. THP-1 cells were cultured (see Example 1) and tested in the protein transduction assay described in Example 3.1. GFP-NLS recombinant protein (5 μM) was co-incubated with or without 1 μM CM18-TAT-Cys, and exposed to the THP-1 cells for 5 minutes, before being subjected to flow cytometry analysis as described in Example 3.3. The results are shown in Table 5.5 and in FIG. 17A. Corresponding cellular toxicity data are presented in FIG. 17B.

TABLE 5.5

Figure 17A:
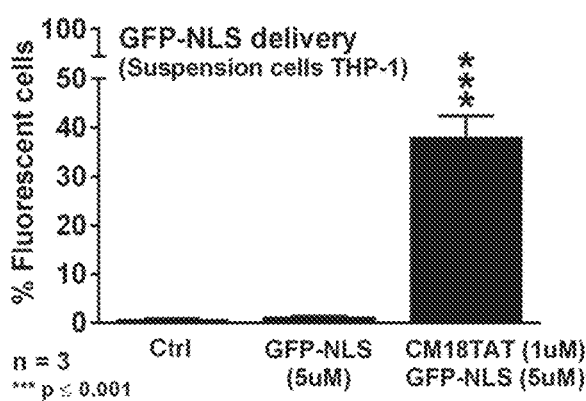
FIGS. 17A and 17B show the results of a GFP-NLS transduction efficiency experiment in which GFP-NLS cargo protein (5 μM) was co-incubated with or without 1 μM CM18-TAT-Cys (labeled "CM18TAT"), prior to being exposed to THP-1 cells. Cells were evaluated by flow cytometry and the percentage of fluorescent (GFP-positive) cells is shown in FIG. 17A, and corresponding cell toxicity data is shown in FIG. 17B.
Figure 17B:
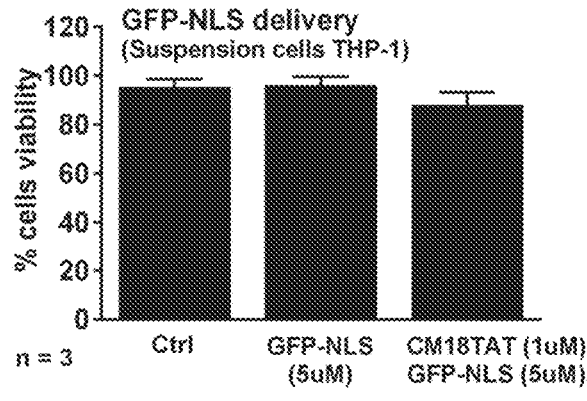

Data in FIGS. 17A and 17B

| | | | FIG. 17A | | FIG. 17B Cell viability |
|---|---|---|---|---|---|
| Shuttle | Cells | Shuttle Conc. (μM) | Mean (%) (n = 3) | Standard deviation | (%) (±St Dev.; n = 3) |
| No shuttle (Ctrl) | THP-1 | 0 | 1.23 | 0.16 | 95 ± 4 |
| GFP-NLS alone | | 0 | 2.49 | 0.37 | 96 ± 3 |
| CM18-TAT-Cys | | 1 | 38.1 | 4.16 | 85 ± 6 |

The results in Table 5.5 and FIG. 17 demonstrate the ability of the shuttle agents to deliver protein cargo intracellularly to a human monocytic cell line grown in suspension.

Example 6

Peptide Shuttle Agents Increase Transduction Efficiency of an FITC-Labeled Anti-Tubulin Antibody The experiments in Examples 3-5 showed the ability of shuttle agents to increase the transduction efficiency of GFP, TAT-GFP, and GFP-NLS. The experiments presented in this example show that the shuttle agents can also deliver a larger protein cargo: an FITC-labeled anti-tubulin antibody. The FITC-labeled anti-tubulin antibody was purchased from (Abcam, ab64503) and has an estimated molecular weight of 150 KDa. The delivery and microscopy protocols are described in Example 3.

Figure 18:
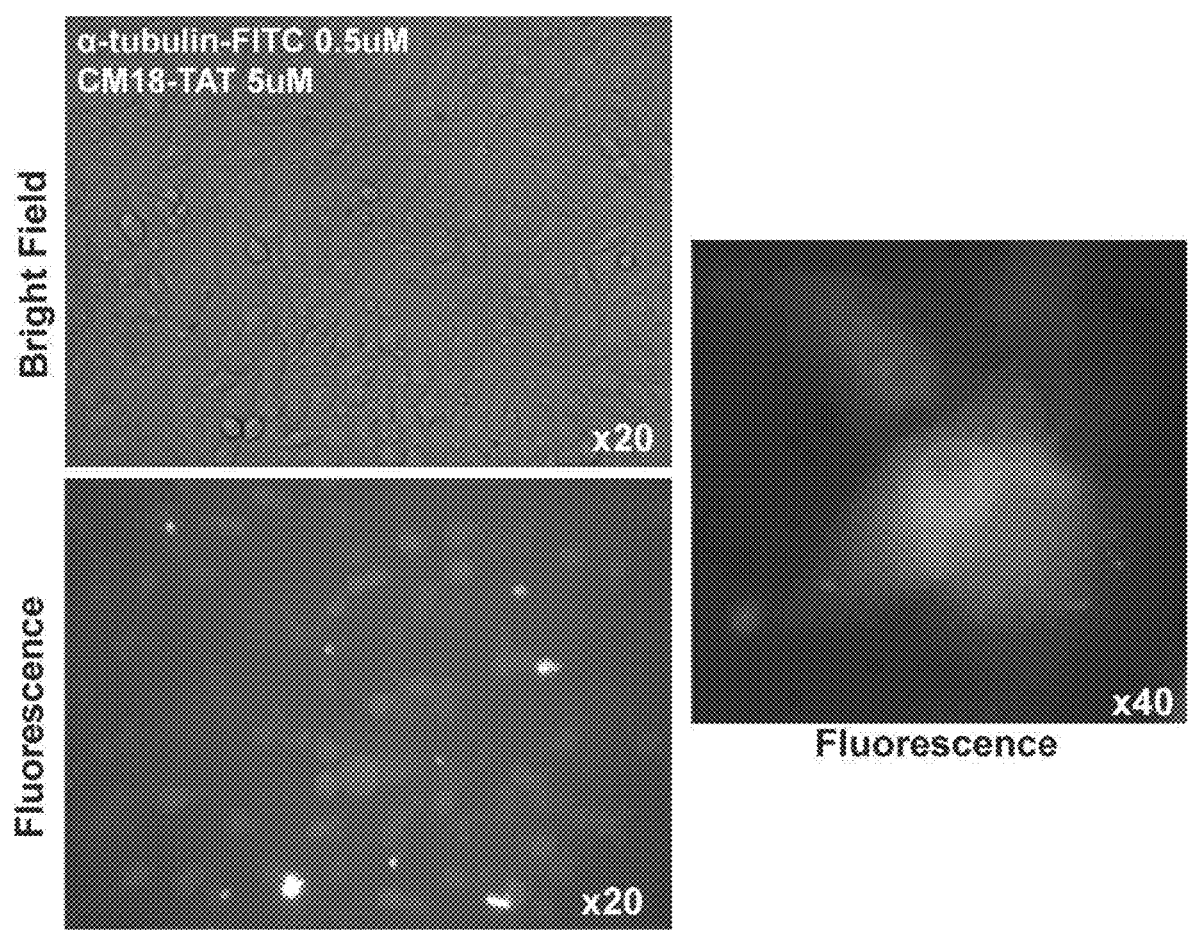
FIG. 18 shows the results of a transduction efficiency experiment in which the cargo protein, FITC-labeled anti-tubulin antibody (0.5 μM), was co-incubated with 5 μM of CM18-TAT-Cys (labeled "CM18-TAT"), prior to being exposed to HeLa cells. Functional antibody delivery was visualized by bright field (20×) and fluorescence microscopy (20× and 40×), in which fluorescent tubulin fibers in the cytoplasm were visualized.

6.1 Transduction of a Functional Antibody by CM18-TAT-Cys in HeLa Cells: Visualization by Microscopy FITC-labeled anti-tubulin antibody (0.5 μM) was co-incubated with 5 μM of CM18-TAT-Cys and exposed to HeLa cells for 1 hour. Antibody delivery was visualized by bright field (20×) and fluorescence microscopy (20× and 40×). As shown in FIG. 18, fluorescent tubulin fibers in the cytoplasm were visualized, demonstrating the functionality of the antibody inside the cell.

6.2 Transduction of a Functional Antibody by CM18-TAT-Cys, CM18-Penetratin-Cys, and Dimers in HeLa Cells: Flow Cytometry HeLa cells were cultured and tested in the protein transduction assay described in Example 3.1. FITC-labeled anti-tubulin antibody (0.5 μM) was co-incubated with 3.5 μM of CM18-TAT-Cys, CM18-Penetratin-Cys or dCM18-Penetratin-Cys, or a combination of 3.5 μM of CM18-TAT-Cys and 0.5 μM of dCM18-Penetratin-Cys, and exposed to HeLa cells for 1 hour. The cells were subjected to flow cytometry analysis as described in Example 3.3. Results are shown in Table 6.1 and FIG. 19A. Corresponding cellular toxicity data are presented in FIG. 19B.

TABLE 6.1

Figure 19A:
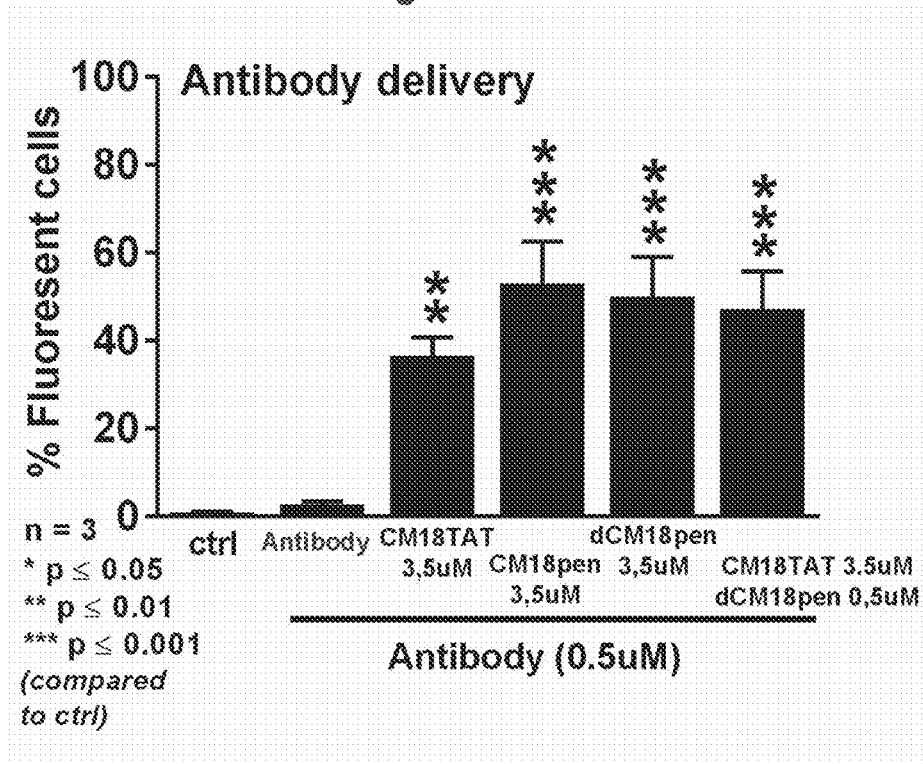
FIGS. 19A and 19B shows the results of an FITC-labeled anti-tubulin antibody transduction efficiency experiment in which the antibody cargo protein (0.5 μM) was co-incubated with 3.5 μM of CM18-TAT-Cys (labeled "CM18TAT"), CM18-Penetratin-Cys (labeled "CM18pen") or dCM18-Penetratin-Cys (labeled "dCM18pen"), or a combination of 3.5 μM of CM18-TAT-Cys and 0.5 μM of dCM18-Penetratin-Cys, prior to being exposed to HeLa cells. Cells were evaluated by flow cytometry and the percentage of fluorescent (FITC-positive) cell is shown in FIG. 19A, and corresponding cell toxicity data is shown in FIG. 19B.
Figure 19B:
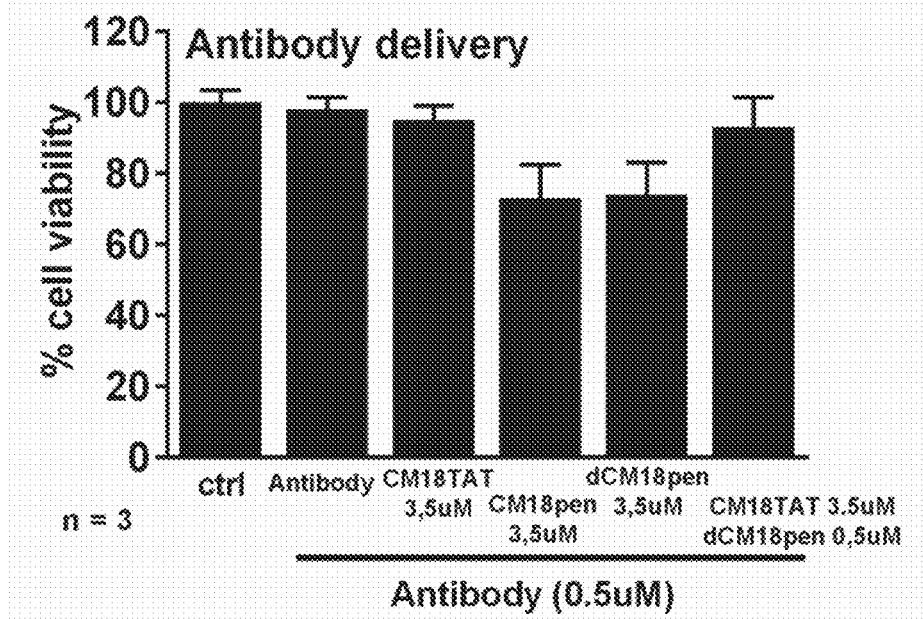

Data from FIG. 19A and 19B

| Domains | Shuttle agent | Cells | Shuttle Conc. (μM) | FIG. 19A Mean (%) (n = 3) | Standard deviation | FIG. 19B Cell viability (%) (± St. Dev.; n = 3) |
|---|---|---|---|---|---|---|
| — | No shuttle ("Ctrl") | HeLa | 0 | 0.9 | 0.06 | 98 ± 1.0 |
| — | Antibody alone ("antibody") | HeLa | 0 | 2.66 | 0.61 | 96 ± 3.4 |
| ELD-CPD | CM18-TAT-Cys | HeLa | 3.5 | 36.56 | 4.06 | 95 ± 4.06 |
| | CM18-Penetratin-Cys | HeLa | 3.5 | 53.05 | 9.5 | 73 ± 9.5 |
| ELD-CPD dimer | dCM18-Penetratin-Cys | HeLa | 3.5 | 50.23 | 9.12 | 74 ± 9.0 |
| ELD-CPD + ELD-CPD dimer | CM18-TAT-Cys + dCM18-Penetratin-Cys | HeLa | 3.5 0.5 | 47.19 | 8.5 | 93 ± 8.5 |

The results in Table 6.1 and FIGS. 18 and 19 show that both CM18-TAT-Cys and CM18-Penetratin-Cys facilitate intracellular delivery of an FITC-labeled anti-tubulin antibody. In contrast to the results with GFP, TAT-GFP, and GFP-NLS in Examples 3-5, CM18-Penetratin-Cys was able to deliver the antibody cargo intracellularly when used alone (without CM18-TAT-Cys). However, combination of CM18-TAT-Cys and dCM18-Penetratin-Cys allowed for higher intracellular delivery as compared with CM18-TAT-Cys alone, and with less cell toxicity as compared to CM18-Penetratin-Cys and dCM18-Penetratin-Cys (see FIGS. 19A and 19B).

Example 7

CM18-TAT-Cys Enables Intracellular Plasmid DNA Delivery but Poor Plasmid Expression The ability of the CM18-TAT-Cys shuttle agent to deliver plasmid DNA intracellularly was tested in this example on HEK293A cells using a plasmid encoding GFP.

7.1 Transfection Assay in HEK293A Cells

One day before the transfection assay was performed, mammalian cells (HEK293A) in exponential growth phase were harvested and plated in a 24-well plate (50,000 cells per well). The cells were incubated overnight in appropriate growth media containing FBS. The next day, in separate sterile 1.5 mL tubes, pEGFP labeled with a Cy5™ fluorochrome was mixed for 10 min at 37° C. with CM18-TAT-Cys (0.05, 0.5, or 5 p M) in fresh PBS at a final 100 μL volume. The media in wells was removed and the cells were quickly washed three times with PBS and 500 μL of warm media without FBS was added. The pEGFP and CM18-TAT-Cys solution was added to the cells and incubated at 37° C. for 4 hours. After the incubation, cells were washed with PBS and fresh media containing FBS was added. Cells were incubated at 37° C. before being subjected to flow cytometry analysis as described in Example 3.

7.2 Plasmid DNA Delivery with CM18-TAT-Cys

Plasmid DNA (pEGFP) was labeled with a Cy5™ dye following the manufacturer's instructions (Mirus Bio LLC). Cy5™ Moiety did not influence transfection efficiency when compared to unlabelled plasmid using standard transfection protocol (data not shown). Flow cytometry analysis allowed quantification of Cy5™ emission, corresponding to DNA intracellular delivery, and GFP emission, corresponding to successful nuclear delivery, DNA transcription and protein expression. The results are shown in Table 7.1 and in FIG. 20.

TABLE 7.1

Data from FIG. 20

| Sample | DNA (ng) | Cy5™ fluorescence Mean Cy5™ signal (n = 3) | Standard deviation | GFP expression Mean (% of cells with GFP signal; n = 3) | Standard deviation |
|---|---|---|---|---|---|
| pEGFP-Cy5 alone | 500 | 914 | 0 | 0.0% | n/a |
| CM18-TAT-Cys, 0.05 μM | 500 | 1450 | 120 | 0.0% | n/a |
| CM18-TAT-Cys, 0.5 μM | 500 | 8362 | 294 | 0.0% | n/a |
| CM18-TAT-Cys, 5 μM | 500 | 140 497 | 3977 | 0.1% | n/a |

The results shown in Table 7.1 and in FIG. 20 show that CM18-TAT-Cys was able to increase the intracellular delivery the plasmid DNA when used at 0.05, 0.5 and 5 μM concentrations, as compared to cell incubated with DNA alone ("pEGFP-Cy5"). However, no expression of GFP was detected in the cells, which suggests that very little of the plasmid DNA gained access to the cytoplasmic compartment, allowing nuclear localization. Without being bound by theory, it is possible that the plasmid DNA was massively sequestered in endosomes, preventing escape to the cytoplasmic compartment. Salomone et al., 2013 reported the use of a CM18-TAT11 hybrid peptide to deliver plasmid DNA intracellularly. They used the luciferase enzyme reporter assay to assess transfection efficiency, which may not be ideal for quantifying the efficiency of cytoplasmic/nuclear delivery, as the proportion of plasmid DNA that is successfully released from endosomes and delivered to the nucleus may be overestimated due to the potent activity of the luciferase enzyme. In this regard, the authors of Salomone et al., 2013 even noted that the expression of luciferase occurs together with a massive entrapment of (naked) DNA molecules into vesicles, which is consistent with the results shown in Table 7.1 and in FIG. 20.

7.3 Plasmid DNA Delivery by Peptides in HeLa Cells

Following the poor transfection efficiency of the peptide CM18-TAT-Cys (0.1%, see Table 7.1) observed in HEK293A cells, the experiment was repeated with CM18-TAT-Cys in another cell line (HeLa), along with other peptides listed in Table 1.3, Table B1, and Table C1.

One day before the transfection assay was performed, HeLa cells in exponential growth phase were harvested and plated in a 96-well plate (10,000 cells per well). The cells were incubated overnight in appropriate growth media containing FBS. The next day, in separate sterile 1.5 mL tubes, the peptide to be tested and the polynucleotide cargo (pEGFP-C1) were mixed for 10 min at 37° C. in serum-free medium at a final volume of 50 µL. The media in wells was removed and the cells were quickly washed one time with PBS at 37° C. The mix containing the peptide to be tested and the polynucleotide cargo was added to the cells and incubated at 37° C. for the indicated period of time (e.g., 1 min, 1 h or 4 h). After the incubation, cells were washed one time with PBS at 37° C. and fresh media containing FBS was added. Cells were incubated at 37° C. before being subjected to flow cytometry analysis as described in Example 3.2, to qualify transfection efficiency (i.e., cells expression EGFP) and viability. Results are shown in Table 7.2. Table 7.2. DNA transfection in HeLa cells using peptides Peptide Mean % cells with GFP signal Cell viability (%)

TABLE 7.2

DNA transfection in HeLa cells using peptides

| Peptide | Mean % cells with GFP signal (±St. Dev.; n = 3) | Cell viability (%) (±St. Dev.; n = 3) |
|---|---|---|
| No peptide (neg. control) | 0.0 ± 0.0 | 100 |
| PTD4-KALA | 0.85 ± 0.04 | 53.64 ± 3.91 |
| FSD9 | 0.81 ± 0.09 | 36.1 ± 3.41 |
| KALA | 0.79 ± 0.06 | 90.62 ± 4.16 |
| His-CM18-Transportan | 0.55 ± 0.01 | 11.89 ± 1.07 |
| FSD12 | 0.37 ± 0.14 | 58.6 ± 2.07 |
| dCM18-Pen-Cys | 0.35 ± 0.02 | 3.36 ± 0.26 |
| His-CM18-PTD4-His | 0.34 ± 0.03 | 29.4 ± 2.38 |
| FSD2 | 0.34 ± 0.00 | 55.77 ± 4.19 |
| Pep1-KALA | 0.31 ± 0.03 | 92.47 ± 3.42 |
| F5D25 | 0.31 ± 0.02 | 98.19 ± 1.19 |
| FSD7 | 0.29 ± 0.07 | 60.9 ± 7.59 |
| CM18-PTD4-His | 0.26 ± 0.01 | 29.5 ± 0.21 |
| FSD19 | 0.24 ± 0.01 | 97.41 ± 2.07 |
| FSD10 | 0.21 ± 0.01 | 72.36 ± 8.61 |
| FSD24 | 0.20 ± 0.00 | 96.45 ± 3.02 |
| FSD15 | 0.18 ± 0.02 | 98.3 ± 1.07 |
| 12His-CM18-PTD4 | 0.18 ± 0.01 | 97.55 ± 1.57 |
| CM18-L1-PTD4 | 0.16 ± 0.01 | 84.3 ± 5.64 |
| FSD33 | 0.15 ± 0.01 | 75.3 ± 4.19 |
| TAT-LAH4 | 0.15 ± 0.00 | 96.17 ± 2.70 |
| CM18-L2-PTD4 | 0.14 ± 0.01 | 93.7 ± 3.07 |
| M-His-CM18-TAT-Cys | 0.13 ± 0.01 | 33.1 ± 0.4 |
| FSD42 | 0.12 ± 0.02 | 96.67 ± 1.96 |
| FSD11 | 0.11 ± 0.01 | 46.2 ± 1.35 |
| Xentry-KALA | 0.1 ± 0.02 | 75.3 ± 4.29 |
| FSD5 | 0.1 ± 0.01 | 93.24 ± 8.63 |
| 3HA-CM18-PTD4 | 0.09 ± 0.01 | 51.48 ± 4.83 |
| FSD32 | 0.08 ± 0.02 | 98.36 ± 0.15 |
| CM18-TAT-Cys | 0.08 ± 0.01 | 96.28 ± 1.86 |
| FSD8 | 0.06 ± 0.84 | 42.3 ± 6.42 |
| CM18-L3-PTD4 | 0.06 ± 0.01 | 98.4 ± 0.83 |
| 3His-CM18-PTD4 | 0.06 ± 0.01 | 82.05 ± 6.81 |
| CM18-PTD4 | 0.06 ± 0.01 | 49.64 ± 5.06 |
| TAT-CM18 | 0.06 ± 0.01 | 44.79 ± 4.17 |
| HA-CM18-PTD4 | 0.06 ± 0.0 | 53.21 ± 4.62 |
| His-CM18-TAT | 0.05 ± 0.01 | 13.6 ± 0.18 |
| VSVG-PTD4 | 0.05 ± 0.01 | 96.21 ± 2.57 |
| 9His-CM18-PTD4 | 0.04 ± 0.01 | 98.72 ± 0.93 |
| JST-PTD4 | 0.04 ± 0.01 | 70.2 ± 5.39 |
| His-CM18-PTD4 | 0.04 ± 0.01 | 63.2 ± 4.07 |
| FSD23 | 0.04 ± 0.00 | 98.18 ± 1.03 |
| FSD20 | 0.04 ± 0.00 | 20.49 ± 3.53 |

TABLE 7.2-continued

DNA transfection in HeLa cells using peptides

| Peptide | Mean % cells with GFP signal (±St. Dev.; n = 3) | Cell viability (%) (±St. Dev.; n = 3) |
|---|---|---|
| FSD38 | 0.02 ± 0.00 | 95 ± 2.78 |
| FSD16 | 0.02 ± 0.00 | 99.07 ± 0.73 |
| FSD26 | 0.02 ± 0.00 | 97.2 ± 1.53 |
| FSD27 | 0.02 ± 0.00 | 98 ± 0.63 |
| FSD35 | 0.02 ± 0.00 | 96.14 ± 1.67 |
| CM18 | 0.02 ± 0.00 | 99.4 ± 0.14 |
| FSD30 | 0.02 ± 0.00 | 97.41 ± 2.06 |
| His-CM18-9Arg | 0.02 ± 00.0 | 31.63 ± 0.11 |
| FSD21 | 0.01 ± 0.00 | 96.17 ± 1.69 |
| 6His-PTD4 | 0.01 ± 0.00 | 97.25 ± 1.34 |
| FSD31 | 0.01 ± 0.00 | 98.43 ± 0.43 |
| FSD34 | 0.01 ± 0.00 | 96.43 ± 2.41 |
| FSD36 | 0.01 ± 0.00 | 97.05 ± 1.99 |
| FSD40 | 0.01 ± 0.00 | 98.63 ± 1.08 |
| FSD41 | 0.01 ± 0.00 | 94.38 ± 2.81 |
| FSD28 | 0.01 ± 0.00 | 97 ± 1.11 |
| CM18-Pen-Cys | 0.01 ± 0.0 | 16.1 ± 0.12 |
| PTD4 | 0.00 ± 0.01 | 98.2 ± 0.69 |
| FSD39 | 0.00 ± 0.00 | 99.2 ± 0.61 |
| His-CMH18-PTD4 | 0.00 ± 0.00 | 95.15 ± 2.33 |
| Penetratin | 0.00 ± 0.00 | 97.42 ± 1.03 |
| C(LLKK)3 | 0.00 ± 0.00 | 81.74 ± 2.34 |

All the peptides tested in Table 7.2 showed transfection efficiencies lower than 1%. Furthermore, the low transfection efficiency of CM18-TAT-Cys was confirmed in HeLa cells (0.08%). These results show that peptides which are suitable for delivering polypeptide cargos may not necessarily be suitable for delivering plasmid DNA. For example, the shuttle agent His-CM18-PTD4-His is shown herein to effectively transduce polypeptide cargos (e.g., see Example 10), yet this peptide displayed only a DNA plasmid transfection efficiency of 0.34% (Table 7.2).

Example 8

Addition of a Histidine-Rich Domain to Shuttle Agents Further Improves GFP-NLS Transduction Efficiency 8.1 GFP-NLS Transduction by his-CM18-TAT-Cys in HeLa Cells: Visualization by Microscopy GFP-NLS (5 µM; see Example 5) was co-incubated with 5 µM of CM18-TAT-Cys or His-CM18-TAT and exposed to HeLa cells for 1 hour. Nuclear fluorescence of intracellularly delivered GFP-NLS was confirmed by fluorescence microscopy (data not shown), indicating successful delivery of GFP-NLS to the nucleus.

8.2 GFP-NLS Transduction by his-CM18-TAT in HeLa Cells: Flow Cytometry

HeLa cells were cultured and tested in the protein transduction assay described in Example 3.1. GFP-NLS (5 µM) was co-incubated with 0, 1, 3, or 5 µM of CM18-TAT-Cys or His-CM18-TAT, and exposed to HeLa cells for 1 hour. The cells were subjected to flow cytometry analysis as described in Example 3.3. Results are shown in Table 8.1 and FIG. 21A. Corresponding cellular toxicity data are presented in FIG. 21B.

TABLE 8.1

Data from FIGS. 21A and 21B

| | | | FIG. 21A | | FIG. 21B |
|---|---|---|---|---|---|
| Shuttle agent | Cells | Shuttle Conc. (μM) | Mean (%) cell with GFP signal (n = 3) | Standard deviation | Cell viability (%) (±St. Dev.; n = 3) |
| Ctrl (no shuttle, no GFP-NLS) | HeLa | 0 | 0.63 | 0.10 | 96 ± 3.17 |
| GFP-NLS alone | | 0 | 0.93 | 0.26 | 97 ± 2.05 |
| CM18-TAT-Cys | | 5 | 20.54 | 3.51 | 81 ± 6.34 |
| | | 3 | 15.66 | 2.18 | 89 ± 5.37 |
| | | 1 | 8.64 | 1.11 | 94 ± 4.28 |
| Ctrl (no shuttle, no GFP-NLS) | HeLa | 0 | 0.51 | 0.28 | 95 ± 4.19 |
| GFP-NLS alone | | 0 | 1.07 | 0.42 | 96 ± 3.16 |
| His-CM18-TAT | | 5 | 41.38 | 4.59 | 86 ± 4.59 |
| | | 3 | 29.58 | 3.61 | 91 ± 5.18 |
| | | 1 | 8.45 | 1.83 | 95 ± 3.05 |

Strikingly, the results in Table 8.1 and in FIG. 21 show that His-CM18-TAT was able to increase GFP-NLS protein transduction efficiency by about 2-fold at 3 μM and 5 μM concentrations, as compared to CM18-TAT-Cys. These results suggest that adding a histidine-rich domain to a shuttle agent comprising an ELD and CPD, may significantly increase its polypeptide cargo transduction efficiency. Alternatively or in parallel, combining the shuttle agents with a further independent synthetic peptide containing a histidine-rich domain fused to a CPD (but lacking an ELD) may provide a similar advantage for protein transduction, with the added advantage of allowing the concentration of the histidine-rich domain to be varied or controlled independently from the concentration of the shuttle agent. Without being bound by theory, the histidine-rich domain may act as a proton sponge in the endosome, providing another mechanism of endosomal membrane destabilization.

Example 9

His-CM18-PTD4 Increases Transduction Efficiency and Nuclear Delivery of GFP-NLS, mCherry™-NLS and FITC-Labeled Anti-Tubulin Antibody 9.1 Protein Transduction Protocols
Protocol A: Protein Transduction Assay for Delivery in Cell Culture Medium One day before the transduction assay was performed, cells in exponential growth phase were harvested and plated in a 96-well plate (20,000 cells per well). The cells were incubated overnight in appropriate growth media containing FBS (see Example 1). The next day, in separate sterile 1.5-mL tubes, cargo protein at the desired concentration was pre-mixed (pre-incubated) for 10 min at 37° C. with the desired concentration of shuttle agents in 50 μL of fresh serum-free medium (unless otherwise specified). The media in wells was removed and the cells were washed one to three times (depending on the type of cells used) with PBS previously warmed at 37° C. The cells were incubated with the cargo protein/shuttle agent mixture at 37° C. for the desired length of time. After the incubation, the cells were washed three times with PBS and/or heparin (0.5 mg/mL) previously warmed at 37° C. The washes with heparin were used for human THP-1 blood cells to avoid undesired cell membrane-bound protein background in subsequent analyses (microscopy and flow cytometry). The cells were finally incubated in 50 μL of fresh medium with serum at 37° C. before analysis.

Protocol B: Protein Transduction Assay for Adherent Cells in PBS

One day before the transduction assay was performed, cells in exponential growth phase were harvested and plated in a 96-well plate (20,000 cells per well). The cells were incubated overnight in appropriate growth media containing serum (see Example 1). The next day, in separate sterile 1.5-mL tubes, shuttle agents were diluted in sterile distilled water at room temperature (if the cargo is or comprised a nucleic acid, nuclease-free water was used). Cargo protein(s) were then added to the shuttle agents and, if necessary, sterile PBS was added to obtain the desired concentrations of shuttle agent and cargo in a sufficient final volume to cover the cells (e.g., 10 to 100 μL per well for a 96-well plate). The shuttle agent/cargo mixture was then immediately used for experiments. At least three controls were included for each experiment, including: (1) shuttle agent alone (e.g., at highest concentration tested); (2) cargo alone; and (3) without any cargo or shuttle agent. The media in wells was removed, cells were washed once with PBS previously warmed at 37° C., and the shuttle agent/cargo mixture was then added to cover all cells for the desired length of time. The shuttle agent/cargo mixture in wells was removed, the cells were washed once with PBS, and fresh complete medium was added. Before analysis, the cells were washed once with PBS and fresh complete medium was added.

Protocol C: Protein Transduction Assay for Suspension Cells in PBS

One day before the transduction assay was performed, suspension cells in exponential growth phase were harvested and plated in a 96-well plate (20,000 cells per well). The cells were incubated overnight in appropriate growth media containing serum (see Example 1). The next day, in separate sterile 1.5-mL tubes, shuttle agents were diluted in sterile distilled water at room temperature (if the cargo is or comprised a nucleic acid, nuclease-free water was used). Cargo protein(s) were then added to the shuttle agents and, if necessary, sterile PBS or cell culture medium (serum-free) was added to obtain the desired concentrations of shuttle agent and cargo in a sufficient final volume to resuspend the cells (e.g., 10 to 100 μL per well in a 96-well plate). The shuttle agent/cargo mixture was then immediately used for experiments. At least three controls were included for each experiment, including: (1) shuttle agent alone (e.g., at highest concentration tested); (2) cargo alone; and (3) without any cargo or shuttle agent. The cells were centrifuged for 2 minutes at 400g, the medium was then removed and the cells were resuspended in PBS previously warmed at 37° C. The cells were centrifuged again 2 minutes at 400g, the PBS removed, and the cells were resuspended in the shuttle agent/cargo mixture. After the desired incubation time, 100 μL of complete medium was added directly on the cells. Cells were centrifuged for 2 minutes at 400g and the medium was removed. The pellet was resuspended and washed in 200 μL of PBS previously warmed at 37° C. After another centrifugation, the PBS was removed and the cells were resuspended in 100 μL of complete medium. The last two steps were repeated one time before analysis.

Figure 22A:
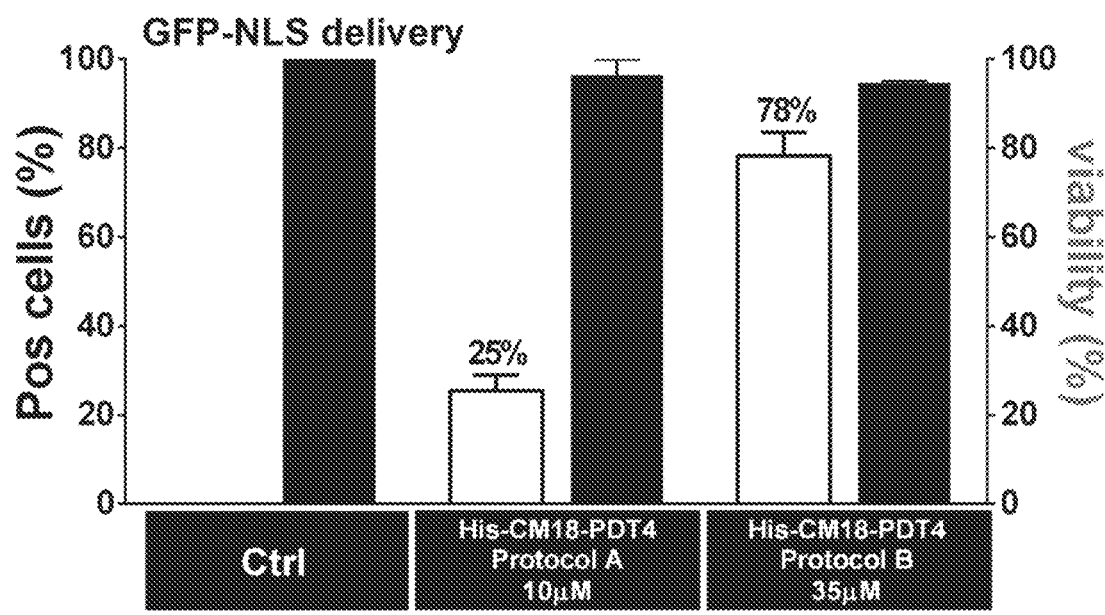
FIGS. 22A and 22B show the results of a transduction efficiency experiment in which GFP-NLS cargo protein was intracellularly delivered using the shuttle His-CM18-PTD4 in HeLa cells. GFP-NLS transduction efficiency was evaluated by flow cytometry and the percentage of GFP fluorescent cells ("Pos cells (%)"), as well as corresponding cell viability data ("viability (%)") are shown.

9.2 GFP-NLS Transduction by his-CM18-PTD4 in HeLa Cells Using Protocol A or B: Flow Cytometry To compare the effects of different protocols on shuttle agent transduction efficiency, HeLa cells were cultured and tested in the protein transduction assays using Protocol A or B as described in Example 9.1. Briefly, GFP-NLS recombinant protein (5 µM; see Example 5.1) was co-incubated with 10 µM of His-CM18-PTD4 and exposed to HeLa cells for 1 hour using Protocol A, or was co-incubated with 35 µM of His-CM18-PTD4 and exposed to HeLa cells for 10 seconds using Protocol B. The cells were subjected to flow cytometry analysis as described in Example 3.3. Results are shown in Table 9.1 and FIG. 22A. ("Pos cells (%)" is the percentage of cells emanating a GFP signal).

TABLE 9.1

Comparison of Protein Transduction Protocols A and B: Data from FIG. 22A

| Protocol | Shuttle | Cells | Conc. of shuttle (µM) | Conc. of GFP-NLS (µM) | Mean % cells with GFP signal (± St. Dev.; n = 3) | Cell viability (%) (± St. Dev.; n = 3) |
|---|---|---|---|---|---|---|
| B | None ("Ctrl") | HeLa | 0 | 5 | 0.53 ± 0.07 | 100 |
| A | His-CM18-PTD4 | HeLa | 10 | 5 | 25.4 ± 3.6 | 96.4 ± 2.7 |
| B | His-CM18-PTD4 | HeLa | 35 | 5 | 78.3 ± 5.3 | 94.6 ± 0.4 |

The above results show that higher protein transduction efficiency for the cargo GFP-NLS using the shuttle agent His-CM18-PTD4 was obtained using Protocol B, as compared to Protocol A.

Figure 22B:
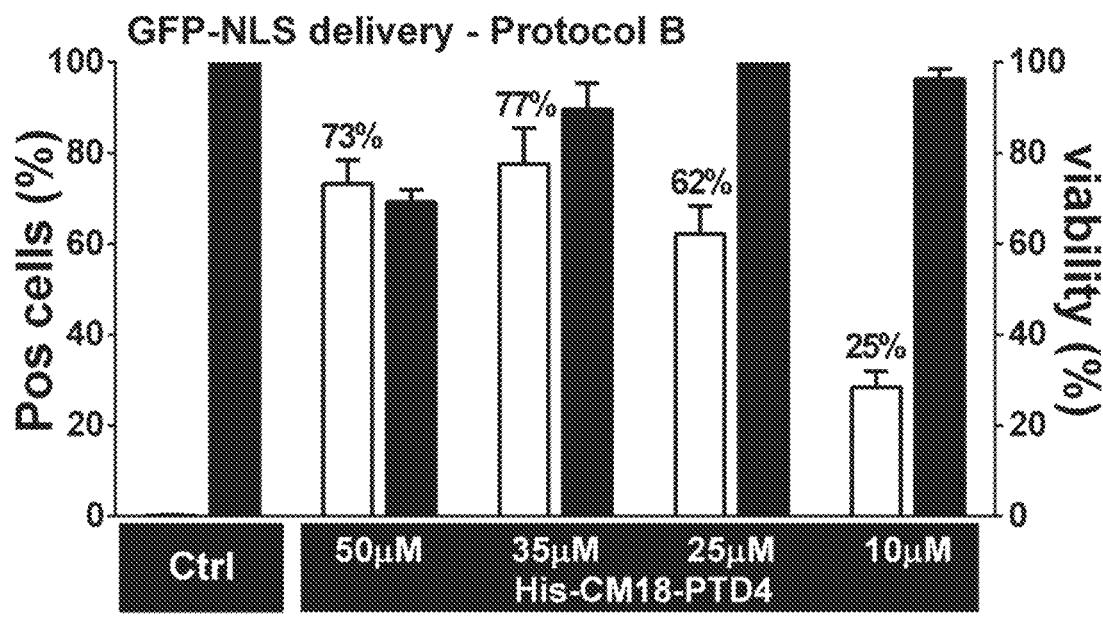

9.3 GFP-NLS Transduction by his-CM18-PTD4 in HeLa Cells Using Protocol B: Flow Cytometry A dose response experiment was performed to evaluate the effect of His-CM18-PTD4 concentration on protein transduction efficiency. HeLa cells were cultured and tested in the protein transduction assay described in Protocol B of Example 9.1. Briefly, GFP-NLS recombinant protein (5 µM; see Example 5.1) was co-incubated with 0, 50, 35, 25, or 10 µM of His-CM18-PTD4, and then exposed to HeLa cells for 10 seconds. The cells were subjected to flow cytometry analysis as described in Example 3.3. Results are shown in Table 9.2 and FIG. 22B.

TABLE 9.2

Dose response of shuttle agent using Protocol B: Data from FIG. 22B

| Protocol | Shuttle | Cells | Conc. of shuttle (µM) | Conc. of GFP-NLS (µM) | Mean % cells with GFP signal (± St. Dev.; n = 3) | Cell viability (%) (± St. Dev.; n = 3) |
|---|---|---|---|---|---|---|
| B | None ("Ctrl") | HeLa | 0 | 5 | 0.13 ± 0.1 | 100 ± 0 |
|  | His-CM18-PTD4 |  | 50 | 5 | 73.2 ± 5.2 | 69.2 ± 2.7 |
|  |  |  | 35 | 5 | 77.7 ± 7.8 | 79.6 ± 5.9 |
|  |  |  | 25 | 5 | 62.1 ± 6.1 | 95.3 ± 3.7 |
|  |  |  | 10 | 5 | 25.3 ± 3.6 | 96.3 ± 2.3 |

The above results show that His-CM18-PTD4 is able to increase GFP-NLS transduction efficiency in HeLa cells in a dose-dependent manner.

9.4 GFP-NLS Transduction by his-CM18-PTD4 in HeLa Cells Using Protocol B: Visualization by Microscopy GFP-NLS recombinant protein (5 µM; see Example 5.1) was co-incubated with 35 µM of His-CM18-PTD4, and then exposed to HeLa cells for 10 seconds using Protocol B as described in Example 9.1. The cells were then subjected to fluorescence microscopy analysis as described in Examples 3.2 and 3.2a.

For the sample results shown in FIGS. 23 and 24, GFP fluorescence of the HeLa cells was immediately visualized by bright field and fluorescence microscopy at 4×, 20× and 40× magnifications after the final washing step.

In FIG. 23, the upper panels in FIGS. 23A, 23B and 23C show nuclei labelling (DAPI) at 4×, 20× and 40× magnifications, respectively, while the lower panels show corresponding GFP-NLS fluorescence. In FIG. 23C, white triangle windows indicate examples of areas of co-labelling between nuclei (DAPI) and GFP-NLS signals. In FIG. 23D, the upper and bottom panels show sample bright field images of the HeLa cells, and the middle panel shows the results of a corresponding FACS analysis (performed as described in Example 3.3), which indicates the percentage of cells in a 96-plate with a GFP signal. No significant GFP fluorescence was observed in negative control samples (i.e., cells exposed to GFP-NLS without any shuttle agent; data not shown).

FIG. 24 shows bright field (FIG. 24A) and fluorescent images (FIG. 24B). The inset in FIG. 24B shows the results of a corresponding FACS analysis (performed as described in Example 3.3), which indicates the percentage of cells in a 96-plate well with a GFP signal. No significant GFP fluorescence was observed in negative control samples (i.e., cells exposed to GFP-NLS without any shuttle agent; data not shown).

For the sample results shown in FIG. 25, the HeLa cells were fixed, permeabilized and subjected to immuno-labelling as described in Example 3.2a before visualization by fluorescence microscopy as described in Example 3.2. GFP-NLS was labelled using a primary mouse monoclonal anti-GFP antibody (Feldan, #A017) and a secondary goat anti-mouse Alexa™-594 antibody (Abcam #150116). The upper panels in FIGS. 25A and 25B show nuclei labelling (DAPI), and the lower panels show corresponding labelling for GFP-NLS. FIGS. 25A and 25B show sample images at 20× and 40× magnifications, respectively. White triangle windows indicate examples of areas of co-labelling between nuclei and GFP-NLS. No significant GFP-NLS labelling was observed in negative control samples (i.e., cells exposed to GFP-NLS without any shuttle agent; data not shown).

FIG. 26 shows sample images captured with confocal microscopy at 63× magnification of living cells. FIG. 26A shows a bright field image, while FIG. 26B shows the corresponding fluorescent GFP-NLS. FIG. 26C is an overlay between the images in FIG. 26A and FIG. 26B. No significant GFP-NLS fluorescence was observed in negative control samples (i.e., cells exposed to GFP-NLS without any shuttle agent; data not shown).

Figure 24C:
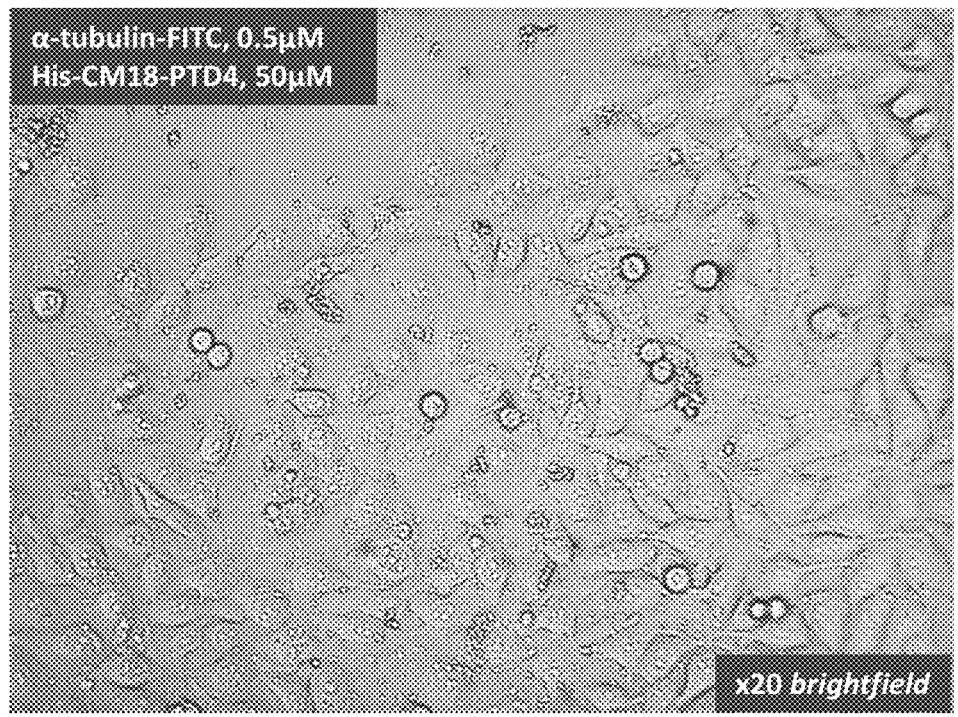
Figure 24D:
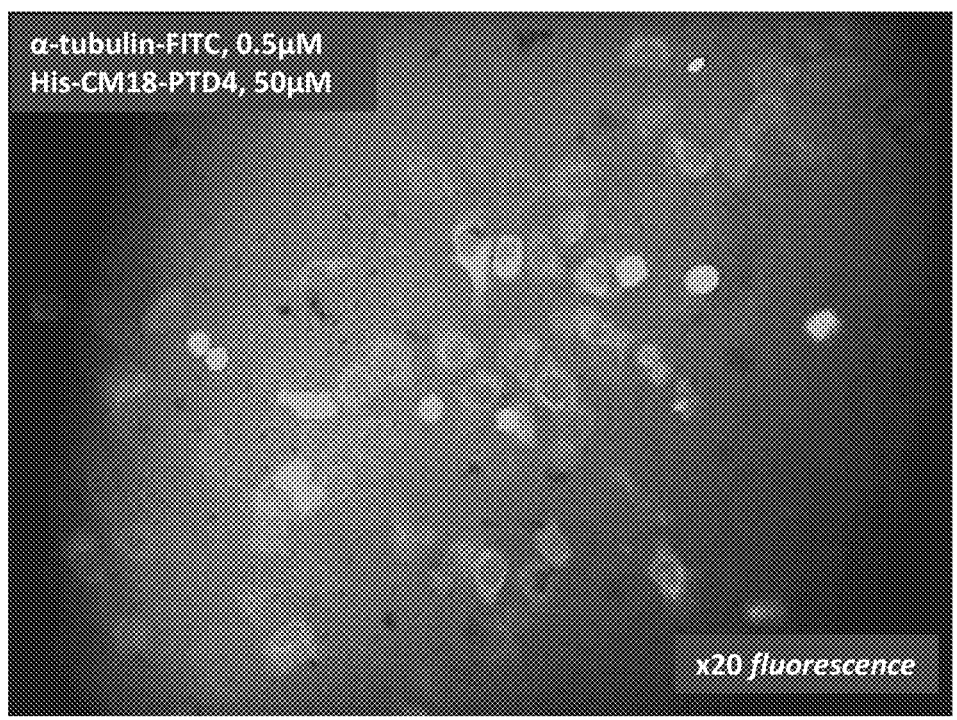

9.4a FTIC-Labeled Anti-Tubulin Antibody Transduction by his-CM18-PTD4 in HeLa Cells Using Protocol B: Visualization by Microscopy FITC-labeled anti-tubulin antibody (0.5 µM; Abcam, ab64503) was co-incubated with 50 µM of His-CM18-PTD4, and then exposed to HeLa cells for 10 seconds using Protocol B as described in Example 9.1. The cells were then subjected to fluorescence microscopy analysis as described in Examples 3.2 and 3.2a, wherein the FITC fluorescence of the anti-tubulin antibody in the HeLa cells was immediately visualized by bright field and fluorescence microscopy at 20× magnification after the final washing step. Sample results are shown in FIGS. 24C and 24D. No significant FTIC fluorescence was observed in negative control samples (i.e., cells exposed to the FITC-labeled anti-tubulin antibody without any shuttle agent; data not shown).

Overall, the results in Examples 9.4 and 9.4a show that GFP-NLS and FITC-labeled anti-tubulin antibody cargos are successfully transduced and delivered to the nucleus and/or the cytosol of HeLa cells in the presence of the shuttle agent His-CM18-PTD4.

9.5 GFP-NLS Kinetic Transduction by his-CM18-PTD4 in HeLa Cells: Visualization by Microscopy GFP-NLS recombinant protein (5 µM; see Example 5.1) was co-incubated with 50 µM of His-CM18-PTD4, and then exposed to HeLa cells for 10 seconds using Protocol B as described in Example 9.1. After a washing step, the GFP fluorescence of the HeLa cells was immediately visualized by fluorescence microscopy (Example 3.2) at 20× magnification after different intervals of time. Typical results are shown in FIG. 27, in which fluorescence microscopy images were captured after 45, 75, 100, and 120 seconds (see FIGS. 27A, 27B, 27C and 27D, respectively).

Figure 27A:
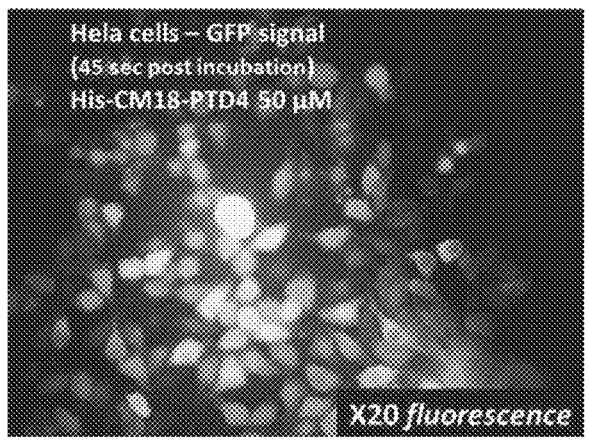
FIGS. 27A-27D show microscopy images of a kinetic (time-course) transduction experiment in HeLa cells, where the fluorescence of GFP-NLS cargo protein was tracked after 45 (FIG. 27A), 75 (FIG. 27B), 100 (FIG. 27C), and 120 (FIG. 27D) seconds following intracellular delivery with the shuttle His-CM18-PTD4. The diffuse cytoplasmic fluorescence pattern observed after 45 seconds (FIG. 27A) gradually becomes a more concentrated nuclear pattern at 120 seconds (FIG. 27D).
Figure 27B:
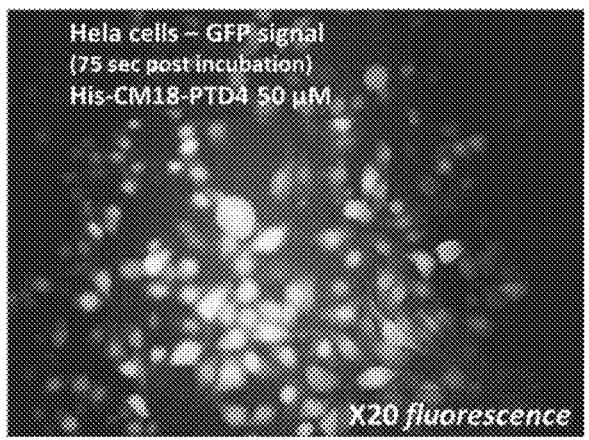
Figure 27C:
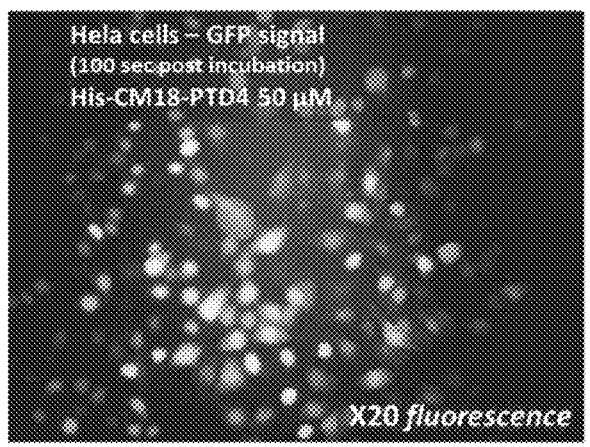
Figure 27D:
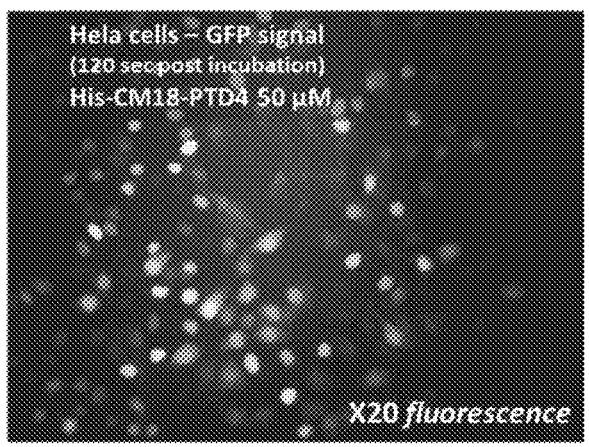
Figure 28A:
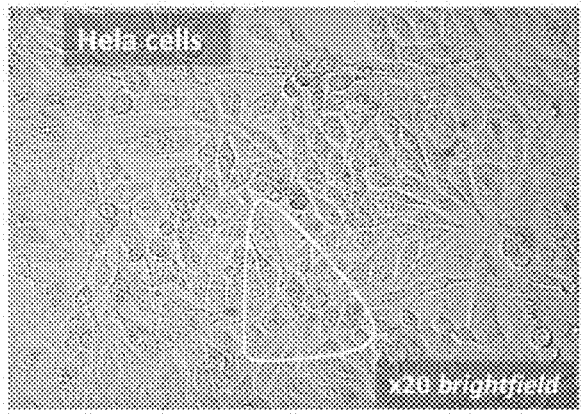
FIGS. 28A-28D show microscopy images of co-delivery transduction experiment in which two cargo proteins (GFP-NLS and mCherry™-NLS) are simultaneously delivered intracellularly by the shuttle His-CM18-PTD4 in HeLa cells. Cells and fluorescent signals were visualized by (FIG. 28A) bright field and (FIG. 28B.28D) fluorescence microscopy. White triangle windows indicate examples of areas of co-labelling between nuclei (DAPI) and GFP-NLS or mCherry™.
Figure 28B:
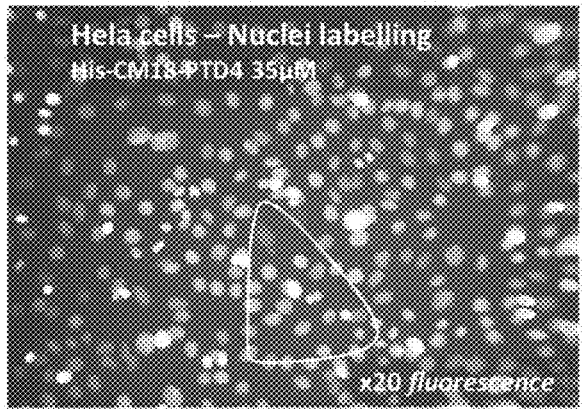
Figure 28C:
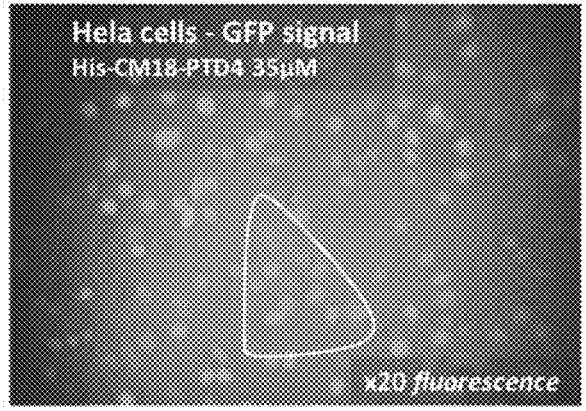
Figure 28D:
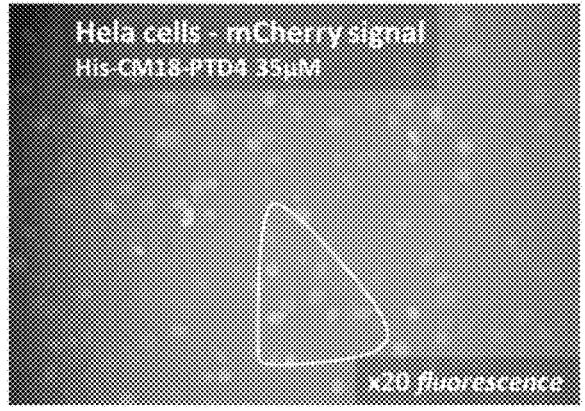

As shown in FIG. 27A, diffuse cellular GFP fluorescence was generally observed after 45 seconds, with areas of lower GFP fluorescence in the nucleus in many cells. These results suggest predominantly cytoplasmic and low nuclear distribution of the GPF-NLS delivered intracellularly via the shuttle agent after 45 seconds. FIGS. 27B-27D show the gradual redistribution of GFP fluorescence to the cell nuclei at 75 seconds (FIG. 27B), 100 seconds (FIG. 27C), and 120 seconds (FIG. 27D) following exposure to the His-CM18-PTD4 shuttle agent and GFP-NLS cargo. No significant cellular GFP fluorescence was observed in negative control samples (i.e., cells exposed to GFP-NLS without any shuttle agent; data not shown).

The results in Example 9.5 show that GFP-NLS is successfully delivered to the nucleus of HeLa cells in the presence of the shuttle agent His-CM18-PTD4 by 2 minutes.

9.6 GFP-NLS and mCherry™-NLS Co-Transduction by his-CM18-PTD4 in HeLa Cells: Visualization by Microscopy mCherry™-NLS recombinant protein was constructed, expressed and purified from a bacterial expression system as described in Example 1.4. The sequence of the mCherry™-NLS recombinant protein was:

[SEQ ID NO: 73]
MHHHHHHGGGGSGGGGSGGASTGIRHVSKCEEDNMAIIKEFMRFKVHMEGS

VNGHEFEIEGEGEGRPYEGTQTAKLKVTKGGPLPFAWDILSPQFMYGSKAY

VKHPADIPDYLKLSFPEGFKWERVMNFEDGGVVTVTQDSSLQDGEFIYKVK

LRGTNFPSDGQVMQKKTMGWEASSERMYPEDGALKGEIKQRLKLKDGGHYD

AEVKTTYKAKKPVQLPGAYNVNIKLDITSHNEDYTIVEQYERAEGRHSTGG

MDELYKGGSGGGSGGGSGWIRASSGGR<u>SSDDEATADSQHAAPPKKKRKV</u>GG

SGGGSGGGSGGGRGTEIS
(MW = 34.71 kDa; pI = 6.68)
NLS sequence is underlined
Serine/glycine rich linkers are in bold GFP-NLS recombinant protein (5 µM; see Example 5.1) and mCherry™-NLS recombinant protein (5 µM) were co-incubated together with 35 µM of His-CM18-PTD4, and then exposed to HeLa cells for 10 seconds using Protocol B as described in Example 9.1. After washing steps, the cells were immediately visualized by bright field and fluorescence microscopy at 20× magnifications as described in Example 3.2. Sample results are shown in FIG. 28, in which corresponding images showing bright field (FIG. 28A), DAPI fluorescence (FIG. 28B), GFP-NLS fluorescence (FIG. 28C), and mCherry™-NLS fluorescence (FIG. 28D) are shown. White triangle windows indicate examples of areas of co-labelling between GFP-NLS and mCherry™ fluorescence signals in cell nuclei. No significant cellular GFP or mCherry™ fluorescence was observed in negative control samples (i.e., cells exposed to GFP-NLS or mCherry™ without any shuttle agent; data not shown).

These results show that GFP-NLS and mCherry™-NLS are successfully delivered together to the nucleus in HeLa cells in the presence of the shuttle agent His-CM18-PTD4.

9.7 GFP-NLS Transduction by his-CM18-PTD4 in THP-1 Suspension Cells: Flow Cytometry The ability of the His-CM18-PTD4 to deliver GFP-NLS in the nuclei of suspension cells was tested using THP-1 cells. THP-1 cells were cultured and tested in the protein transduction assays using Protocols A and C as described in Example 9.1. GFP-NLS (5 µM; see Example 5.1) was co-incubated with 1 µM of His-CM18-PTD4 and exposed to THP-1 cells for 1 hour (Protocol A), or was co-incubated with 5 µM of His-CM18-PTD4 and exposed to THP-1 cells for 15 seconds (Protocol C). The cells were subjected to flow cytometry analysis as described in Example 3.3. Results are shown in Table 9.3 and in FIG. 31.

TABLE 9.3

Figure 31:
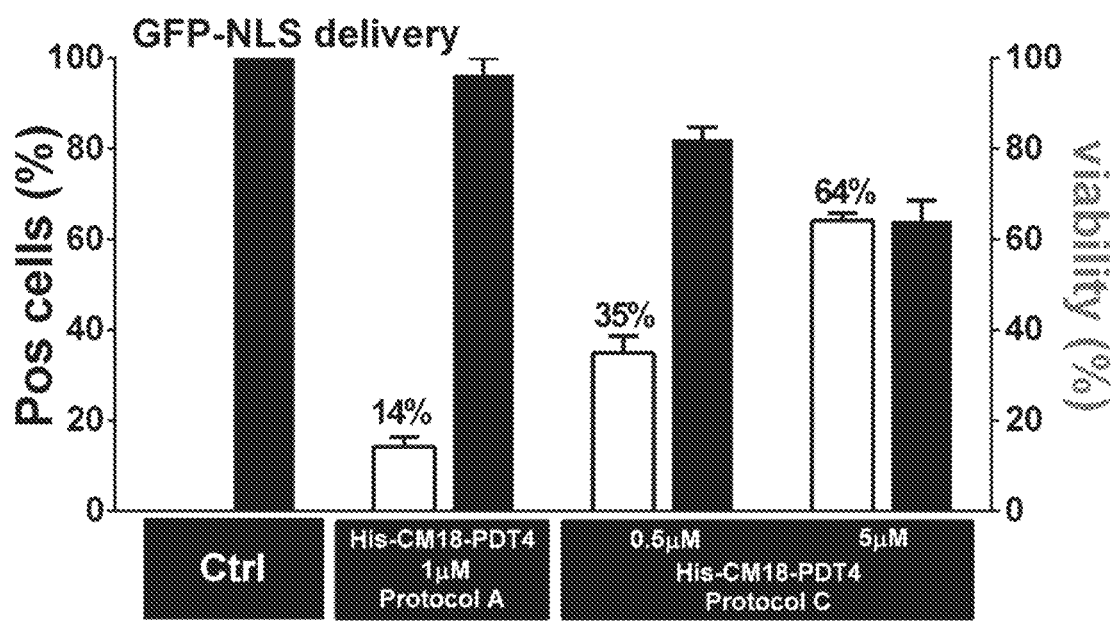
FIG. 31 shows the results of a transduction efficiency experiment in which GFP-NLS cargo protein was intracellularly delivered using the shuttle His-CM18-PTD4 in THP-1 cells using different Protocols (Protocol A vs C). GFP-NLS transduction efficiency was evaluated by flow cytometry and the percentage of GFP fluorescent cells ("Pos cells (%)"), as well as corresponding cell viability data ("viability (%)") are shown. "Ctrl" corresponds to THP-1 cells exposed to GFP-NLS cargo protein in the absence of a shuttle agent.

Data from FIG. 31

| Protocol | Shuttle | Cells | Conc. of shuttle (µM) | Conc. of GFP-NLS (µM) | Mean % cells with GFP signal (± St. Dev.; n = 3) | Cell viability (%) (± St. Dev.; n = 3) |
|---|---|---|---|---|---|---|
| C | No shuttle ("Ctrl") | THP-1 | 0 | 5 | 0.2 ± 0.03 | 99.1 ± 0.7 |
| A | His-CM18-PTD4 | | 1 | 5 | 14.2 ± 2.2 | 96.9 ± 3.6 |
| C | His-CM18-PTD4 | | 0.5 | 5 | 34.9 ± 3.8 | 82.1 ± 2.7 |
| | | | 5 | 5 | 64.1 ± 1.6 | 64.0 ± 4.1 |

9.8 GFP-NLS Transduction by his-CM18-PTD4 in THP-1 Cells: Visualization by Microscopy GFP-NLS recombinant protein (5 µM; see Example 5.1) was co-incubated with 5 µM of His-CM18-PTD4, and then exposed to THP-1 cells for 15 seconds using Protocol C as described in Example 9.1. The cells were subjected to microscopy visualization as described in Example 3.2.

For the sample results shown in FIG. 32, GFP fluorescence of the HeLa cells was immediately visualized by bright field (upper panels) and fluorescence (lower panels) microscopy at 4×, 10× and 40× magnifications (FIG. 32A-32C, respectively) after the final washing step. White triangle windows in FIG. 32C indicate examples of areas of co-labelling between bright field and fluorescence images. FIG. 32D shows typical results of a corresponding FACS analysis (performed as described in Example 3.3), which indicates the percentage of cells in a 96-plate well with a GFP signal. Additional results are shown in FIG. 33, in which FIGS. 33A and 33B show bright field images, and FIGS. 33C and 33D show corresponding fluorescence images. White triangle windows indicate examples of areas of co-labelling between FIGS. 33A and 33C, as well as FIGS. 33B and 33D. The right-most panel shows typical results of a corresponding FACS analysis (performed as described in Example 3.3), which indicates the percentage of cells in a 96-plate well with a GFP signal.

No significant cellular GFP fluorescence was observed in negative control samples (i.e., cells exposed to GFP-NLS without any shuttle agent; data not shown).

The results in this example show that GFP-NLS is successfully delivered intracellularly in THP-1 cells in the presence of the shuttle agent His-CM18-PTD4.

Example 10

Different Multi-Domain Shuttle Agents, but not Single-Domain Peptides, Successfully Transduce GFP-NLS in HeLa and THP-1 Cells 10.1 GFP-NLS Transduction by Different Shuttle Agents in HeLa Cells: Flow Cytometry HeLa cells were cultured and tested in the protein transduction assays using Protocol B as described in Example 9.1. Briefly, GFP-NLS recombinant protein (5 µM; see Example 5.1) was co-incubated with 50 µM of different shuttle agents and exposed to the HeLa cells for 10 seconds. The cells were subjected to flow cytometry analysis as described in Example 3.3. Results are shown in Table 10.1 and FIG. 29A. "Pos cells (%)" is the mean percentages of all cells that emanate a GFP signal. The negative control ("Ctrl") corresponds to cells that were incubated with GFP-NLS recombinant protein (5 µM) without any shuttle agent.

TABLE 10.1

Figure 29A:
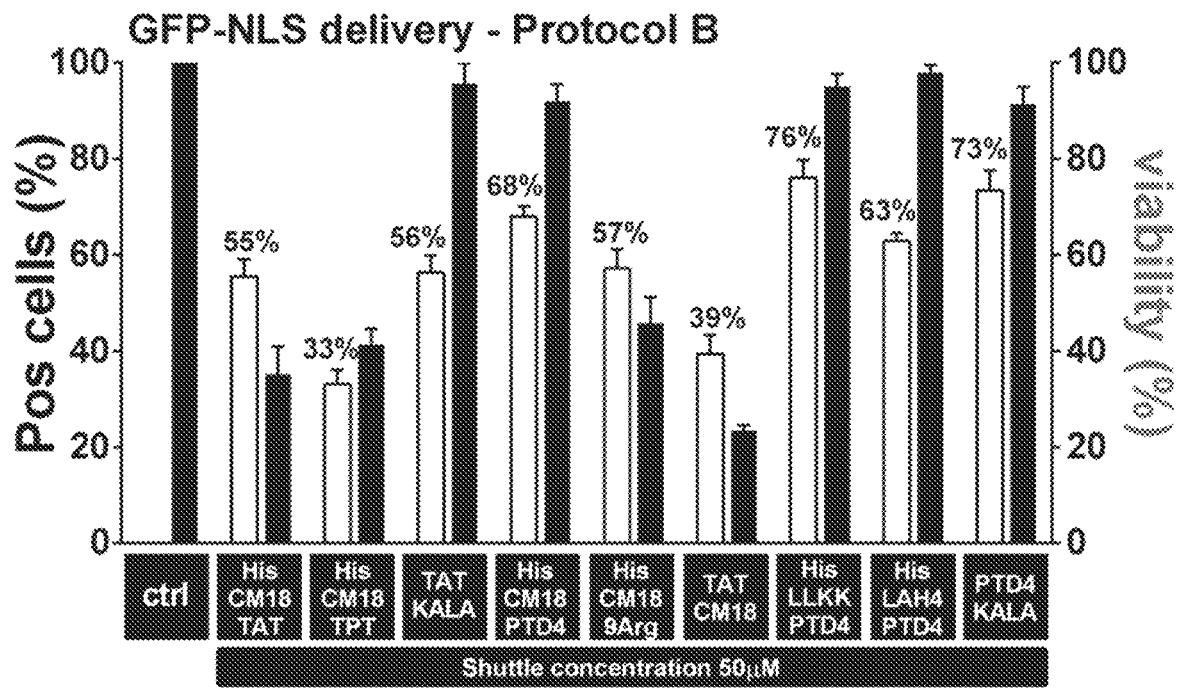
FIGS. 29A-29I show the results of GFP-NLS transduction efficiency experiments in HeLa cells using different shuttle agents or single-domain/control peptides. GFP-NLS transduction efficiency was evaluated by flow cytometry and the percentage of GFP fluorescent cells ("Pos cells (%)"), as well as corresponding cell viability data ("viability (%)") are shown in FIGS. 29A, 29B, 29D-29G and 29I.

| | Data from FIG. 29A | | | | | |
|---|---|---|---|---|---|---|
| Protocol | Shuttle agent | Cells | Conc. of shuttle (µM) | Conc. of GFP-NLS (µM) | Mean % cells with GFP signal (± St. Dev.; n = 3) | Cell viability (%) (± St. Dev.; n = 3) |
| B | No shuttle ("ctrl") | HeLa | 0 | 5 | 0 | 100 |
| | His-CM18-TAT | HeLa | 50 | | 55.5 ± 3.6 | 35.2 ± 5.7 |
| | His-CM18-Transportan (TPT) | HeLa | | | 33.2 ± 2.8 | 41.3 ± 3.3 |
| | TAT-KALA | HeLa | | | 56.3 ± 3.6 | 95.6 ± 4.3 |
| | His-CM18-PTD4 | HeLa | | | 68 ± 2.2 | 92 ± 3.6 |
| | His-CM18-9Arg | HeLa | | | 57.2 ± 3.9 | 45.8 ± 5.4 |
| | TAT-CM18 | HeLa | | | 39.4 ± 3.9 | 23.5 ± 1.1 |
| | His-C(LLKK)3C-PTD4 | HeLa | | | 76 ± 3.8 | 95 ± 2.7 |
| | His-LAH4-PTD4 | HeLa | | | 63 ± 1.64 | 98 ± 1.5 |
| | PTD4-KALA | HeLa | | | 73.4 ± 4.12 | 91.4 ± 3.67 |

* His-LAH4-PTD4: the intracellular GFP fluorescence pattern was observed by fluorescence microscopy as being punctate, suggesting that the GFP cargo remained trapped in endosomes.

10.2 GFP-NLS Transduction by Different Shuttle Agents with Varying Incubation Times in HeLa Cells: Flow Cytometry HeLa cells were cultured and tested in the protein transduction assays using Protocol B as described in Example 9.1. Briefly, GFP-NLS recombinant protein (5 µM; see Example 5.1) was co-incubated with 10 µM of TAT-KALA, His-CM18-PTD4, or His-C(LLKK)3C-PTD4 for 1, 2, or 5 minutes. After the final washing step, the cells were subjected to flow cytometry analysis as described in Example 3.3. Results are shown in Table 10.2 and FIG. 29B. "Pos cells (%)" is the mean percentages of all cells that emanate a GFP signal. The negative control ("Ctrl") corresponds to cells that were incubated with GFP-NLS recombinant protein (5 µM) without any shuttle agent.

TABLE 10.2

Figure 29B:
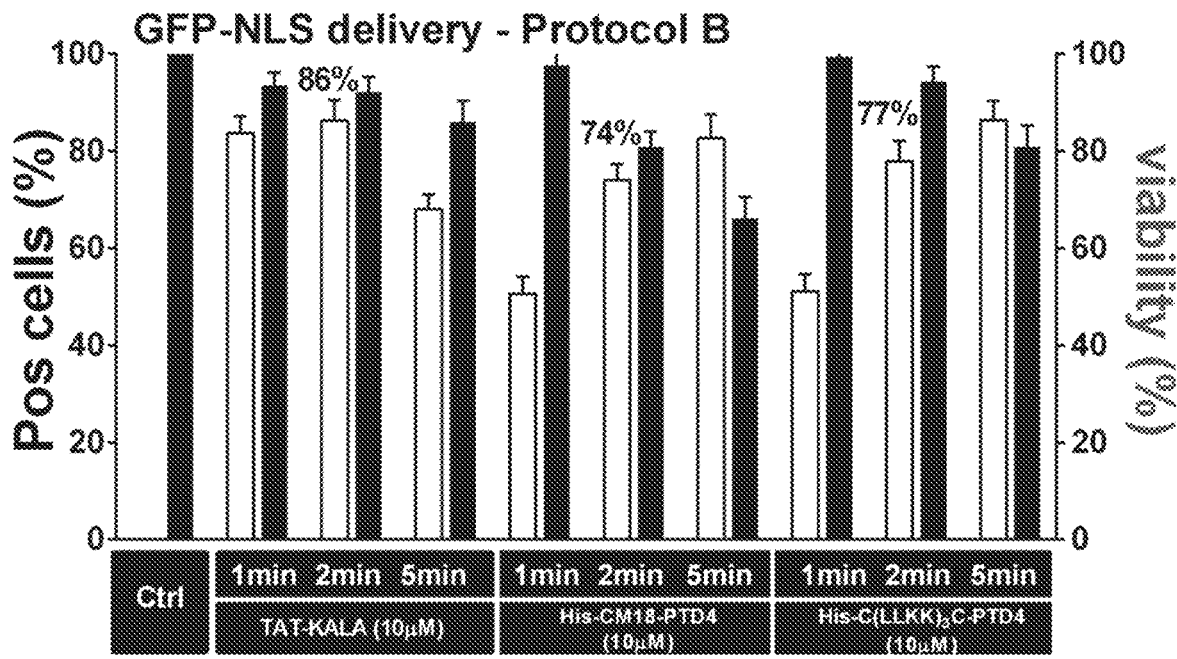

Data from FIG. 29B

| Protocol | Shuttle agent | Cells | Conc. of shuttle (μM) | Incubation time | Mean % cells with GFP signal (± St. Dev.; n = 3) | Cell viability (%) (± St Dev.; n = 3) |
|---|---|---|---|---|---|---|
| — | No shuttle ("Ctrl") | HeLa | 0 | 5 min. | 0 ± n/a | 97.5 ± 1.7 |
| B | TAT-KALA | HeLa | 10 | 1 min. | 83.7 ± 3.5 | 93.5 ± 2.7 |
|  |  |  |  | 2 min. | 86.2 ± 4.3 | 92.1 ± 3.1 |
|  |  |  |  | 5 min. | 68.1 ± 3.0 | 86 ± 4.4 |
|  | His-CM18-PTD4 | HeLa | 10 | 1 min. | 50.6 ± 3.5 | 97.6 ± 2.7 |
|  |  |  |  | 2 min. | 74 ± 3.3 | 80.9 ± 3.2 |
|  |  |  |  | 5 min. | 82.7 ± 5.0 | 66.2 ± 4.4 |
|  | His-C(LLKK)$_3$C-PTD4 | HeLa | 10 | 1 min. | 51.1 ± 3.5 | 99.5 ± 2.7 |
|  |  |  |  | 2 min. | 77.8 ± 4.3 | 94.3 ± 3.2 |
|  |  |  |  | 5 min. | 86.4 ± 4.0 | 80.8 ± 4.4 |

10.3 GFP-NLS Transduction by TAT-KALA, his-CM18-PTD4 and his-C(LLKK)$_3$C-PTD4 with Varying Incubation Times in HeLa Cells: Flow Cytometry HeLa cells were cultured and tested in the protein transduction assays using Protocol C as described in Example 9.1. Briefly, GFP-NLS recombinant protein (5 μM; see Example 5.1) was co-incubated with 5 μM of TAT-KALA, His-CM18-PTD4, or His-C(LLKK)$_3$C-PTD4 for 1, 2, or 5 minutes. After the final washing step, the cells were subjected to flowcytometry analysis as described in Example 3.3. Results are shown in Table 10.3 and FIG. 29C. The negative control ("Ctrl") corresponds to cells that were incubated with GFP-NLS recombinant protein (5 μM) without any shuttle agent.

TABLE 10.3

Figure 29C:
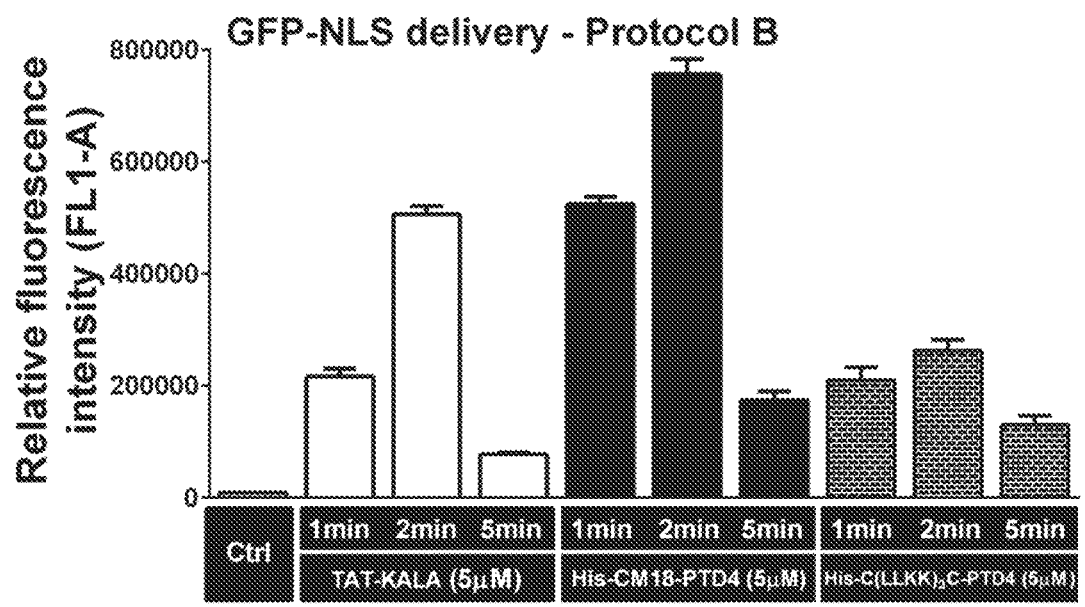

Data from FIG. 29C

| Protocol | Shuttle agent | Cells | Conc. of shuttle (μM) | Incubation time | Relative fluorescence intensity (FL1-A) (n = 3) | St. Dev. |
|---|---|---|---|---|---|---|
|  | No shuttle ("Ctrl") |  | 0 | 5 min. | 8903 | 501 |
| C | TAT-KALA | HeLa | 10 | 1 min. | 216 367 | 13 863.48 |
|  |  |  |  | 2 min. | 506 158 | 14 536.28 |
|  |  |  |  | 5 min. | 78 010 | 2 463.96 |
|  | His-CM18-PTD4 | HeLa | 10 | 1 min. | 524 151 | 12 366.48 |
|  |  |  |  | 2 min. | 755 624 | 26 933.16 |
|  |  |  |  | 5 min. | 173 930 | 15 567.33 |
|  | His-C(LLKK)$_3$C-PTD4 | HeLa | 10 | 1 min. | 208 968 | 23 669.19 |
|  |  |  |  | 2 min. | 262 411.5 | 19 836.84 |
|  |  |  |  | 5 min. | 129 890 | 16 693.29 |

10.4 GFP-NLS Transduction by Different Shuttle Agents in HeLa Cells: Flow Cytometry HeLa cells were cultured and tested in the protein transduction assays using Protocol B as described in Example 9.1. Briefly, GFP-NLS recombinant protein (5 MM; see Example 5.1) was co-incubated with 50 μM of different shuttle agents (see Table 1.3 for amino acid sequences and properties) and exposed to the HeLa cells for 10 seconds. The cells were subjected to flow cytometry analysis as described in Example 3.3. Results are shown in Tables 10.3a & 10.3b and FIGS. 29E & 29F. "Pos cells (%)" is the mean percentages of all cells that emanate a GFP signal. The negative control ("Ctrl") corresponds to cells that were incubated with GFP-NLS recombinant protein (5 μM) without any shuttle agent.

TABLE 10.3a

Figure 29D:
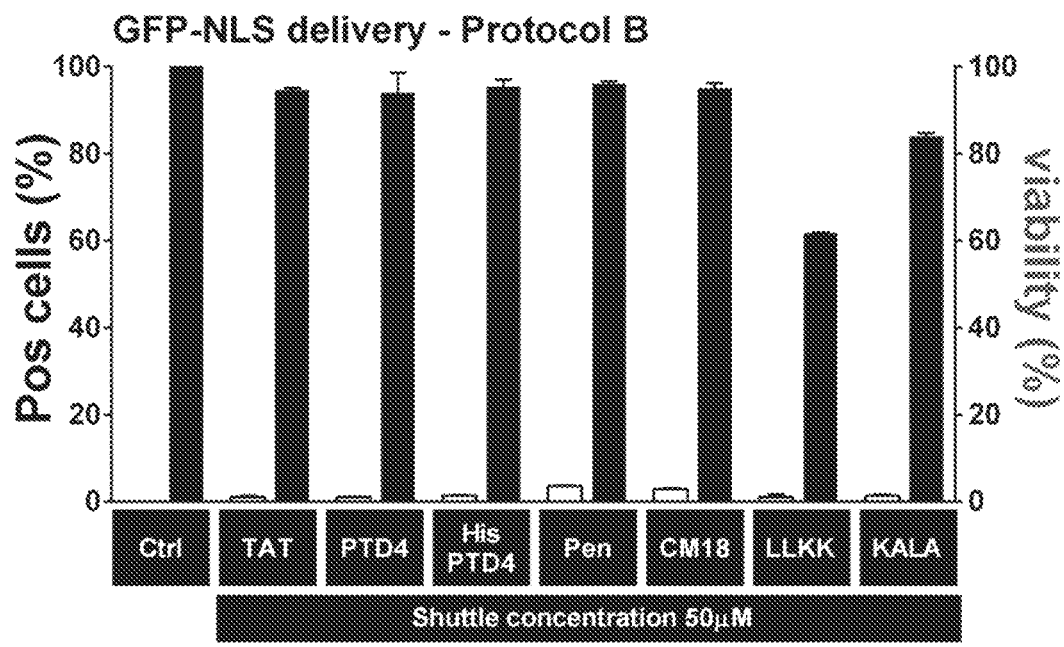
Figure 29E:
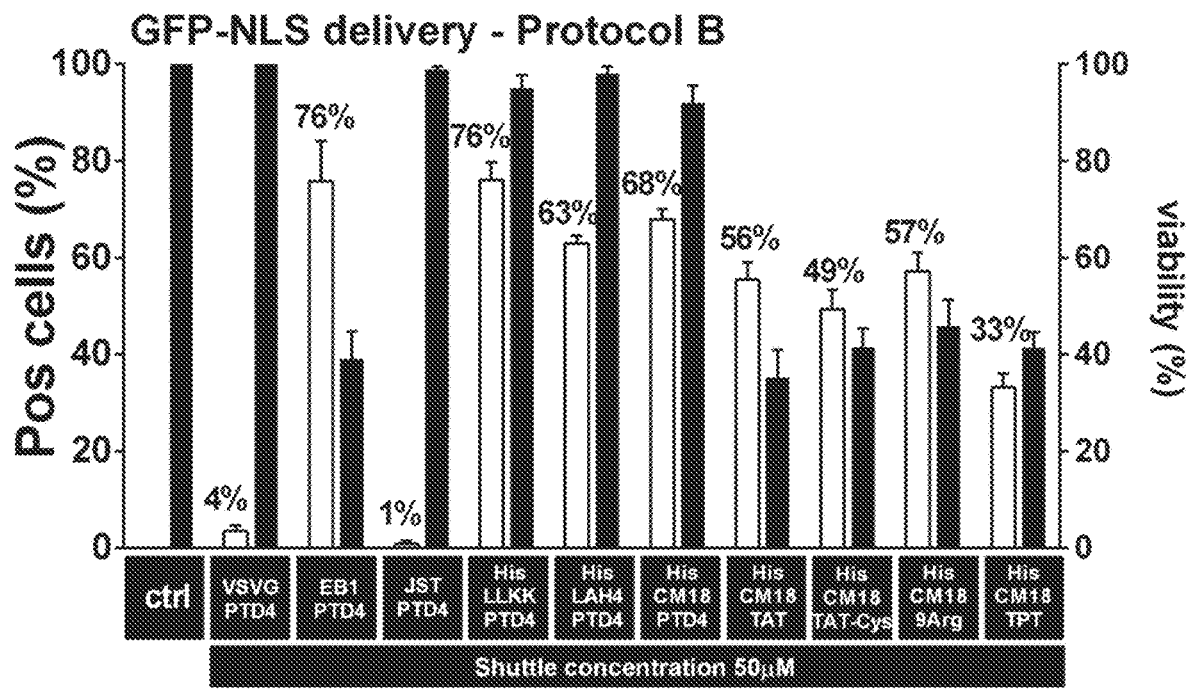

Data from FIG. 29E

| Domain structure | Shuttle agent | Conc. of shuttle (μM) | Conc. of GFP-NLS (μM) | Mean % cells with GFP signal (±St. Dev.; n = 3) | Cell viability (%) (±St. Dev., n = 3) |
|---|---|---|---|---|---|
| — | No shuttle ("Ctrl") | 0 | 5 | 0 | 100 |
| ELD-CPD | VSVG-PTD4 | 50 | 5 | 3.5 ± 1.1 | 100 |
|  | EB1-PTD4 |  |  | 75.8 ± 8.26 | 39 ± 5.6 |
|  | JST-PTD4 |  |  | 0.84 ± 0.69 | 98.9 ± 0.57 |
| His-ELD-CPD | His-C(LLKK)₃C-PTD4 | 50 | 5 | 76 ± 3.8 | 95 ± 2.7 |
|  | His-LAH4-PTD4* |  |  | 63 ± 1.64 | 98 ± 1.5 |
|  | His-CM18-PTD4 |  |  | 68 ± 2.2 | 92 ± 3.6 |
|  | His-CM18-TAT |  |  | 55.5 ± 3.6 | 35.2 ± 5.7 |
|  | His-CM18-TAT-Cys** |  |  | 49.3 ± 4.1 | 41.4 ± 3.91 |
|  | His-CM18-9Arg |  |  | 57.2 ± 3.93 | 45.8 ± 3.53 |
|  | His-CM18-Transportan (TPT) |  |  | 33.2 ± 2.82 | 41.3 ± 3.29 |

*His-LAH4-PTD4: the intracellular GFP fluorescence pattern was observed by fluorescence microscopy as being punctate, suggesting that the GFP cargo remained trapped in endosomes.
**Not shown in FIG. 29E.

TABLE 10.3b

Figure 29F:
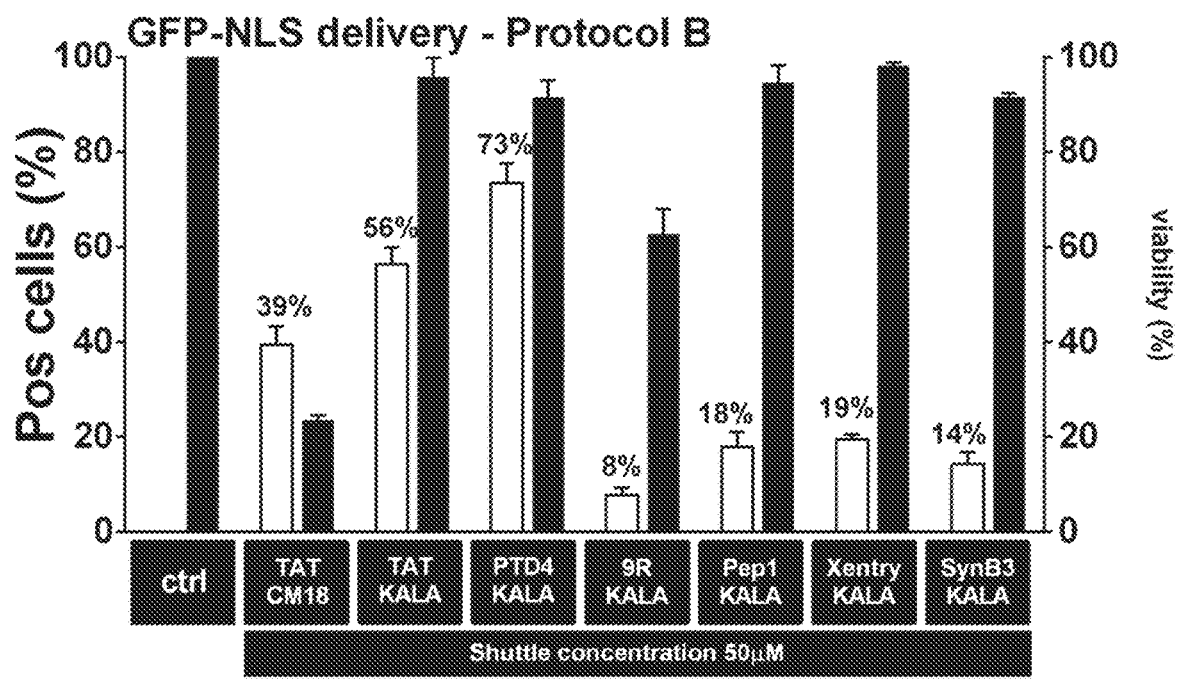

Data from FIG. 29F

| Domain structure | Shuttle agent | Conc. of shuttle (μM) | Conc. of GFP-NLS (μM) | Mean % cells with GFP signal (±St. Dev.; n = 3) | Cell viability (%) (±St. Dev.; n = 3) |
|---|---|---|---|---|---|
| — | No shuttle ("Ctrl") | 0 | 5 | 0 | 100 |
| CPD-ELD | TAT-CM18 | 50 | 5 | 39.4 ± 3.9 | 23.5 ± 1.1 |
|  | TAT-KALA |  |  | 56.3 ± 3.6 | 95.6 ± 4.3 |
|  | PTD4-KALA |  |  | 73.4 ± 4.12 | 91.4 ± 3.67 |
|  | 9Arg-KALA |  |  | 7.8 ± 1.53 | 62.8 ± 5.11 |
|  | Pep1-KALA |  |  | 17.2 ± 3.07 | 94.7 ± 3.77 |
|  | Xentry-KALA |  |  | 19.4 ± 1.01 | 98.3 ± 0.64 |
|  | SynB3-KALA |  |  | 14.3 ± 2.37 | 91.1 ± 0.82 |

HeLa cells were cultured and tested in the protein transduction assays using Protocol B as described in Example 9.1. Briefly, GFP-NLS recombinant protein (5 μM; see Example 5.1) was co-incubated with 10 μM of TAT-KALA, His-CM18-PTD4, or His-C(LLKK)₃C-PTD4 for 1, 2, or 5 minutes. After the final washing step, the cells were subjected to flow cytometry analysis as described in Example 3.3. Results are shown in Tables 10.3c & 10.3b and FIGS. 29G and 29H. "Pos cells (%)" is the mean percentages of all cells that emanate a GFP signal. The negative control ("Ctrl") corresponds to cells that were incubated with GFP-NLS recombinant protein (5 μM) without any shuttle agent.

TABLE 10.3c

Figure 29G:
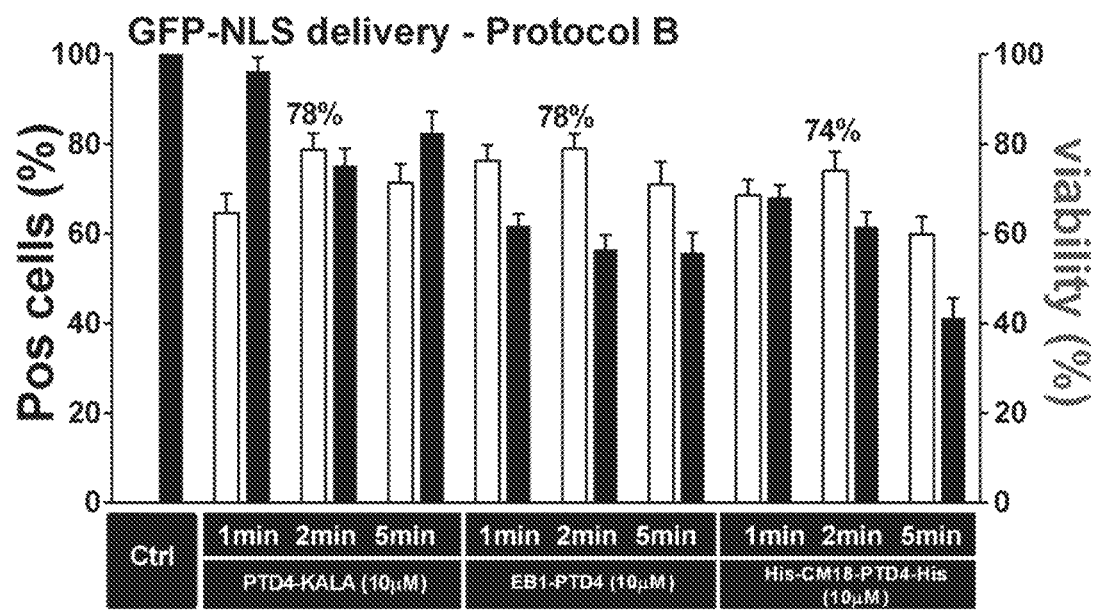

Data from FIG. 29G

| Domain structure | Shuttle agent | Conc. of shuttle (μM) | Conc. of GFP-NLS (μM) | Incubation time (min) | Mean % cells with GFP signal (± St. Dev.; n = 3) | Cell viability (%) (± St. Dev.; n = 3) |
|---|---|---|---|---|---|---|
| — | No shuttle ("Ctrl") | 0 | 5 | 5 | 0 ± n/a | 98.3 ± 0.9 |
| CPD-ELD | PTD4-KALA | 10 | 5 | 1 | 64.6 ± 4.3 | 96.2 ± 3.0 |
|  |  |  |  | 2 | 78.8 ± 3.6 | 75.3 ± 3.8 |
|  |  |  |  | 5 | 71.4 ± 4.2 | 82.4 ± 4.7 |
| ELD-CPD | EB1-PTD4 | 10 | 5 | 1 | 76.3 ± 3.5 | 61.7 ± 2.7 |
|  |  |  |  | 2 | 79.0 ± 3.3 | 56.6 ± 3.2 |
|  |  |  |  | 5 | 71.1 ± 5.0 | 55.8 ± 4.4 |
| His-ELD-CPD-His | His-CM18-PTD4-His | 10 | 5 | 1 | 68.6 ± 3.5 | 68.1 ± 2.7 |
|  |  |  |  | 2 | 74.1 ± 4.3 | 61.6 ± 3.2 |
|  |  |  |  | 5 | 59.8 ± 4.0 | 41.2 ± 4.4 |

TABLE 10.3d

Figure 29H:
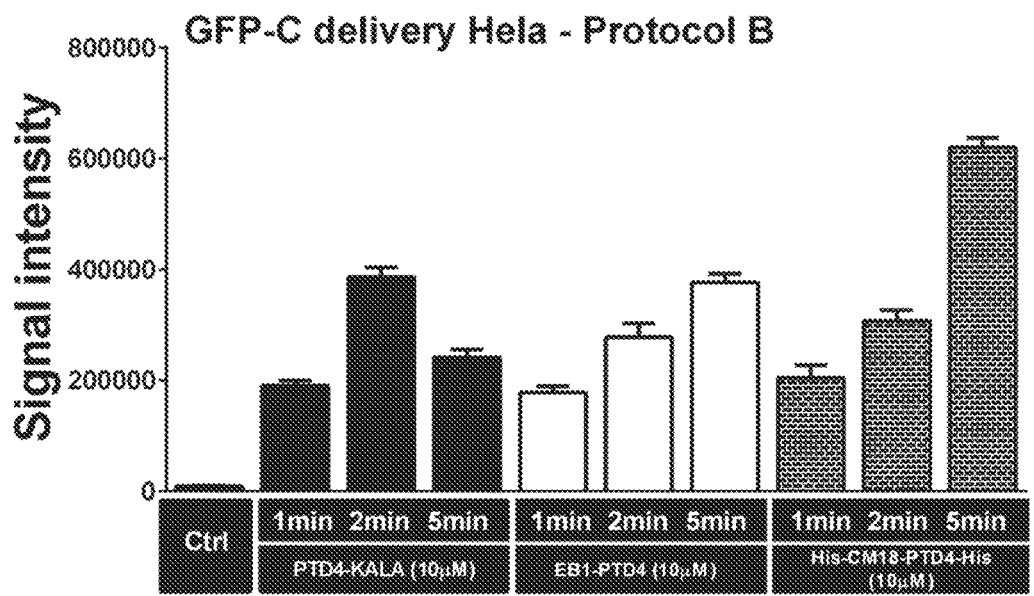

Data from FIG. 29H

| Domain structure | Shuttle agent | Conc. of shuttle (µM) | Conc. of GFP-NLS (µM) | Incubation time (min) | Relative Fluorescence Intensity (FL1-A) (±St. Dev.; n = 3) |
|---|---|---|---|---|---|
| — | No shuttle ("Ctrl") | 0 | 5 | 5 | 8903 ± 501.37 |
| CPD-ELD | PTD4-KALA | 10 | 5 | 1 | 190 287 ± 9445 |
|  |  |  |  | 2 | 386 480 ± 17 229 |
|  |  |  |  | 5 | 241 230 ± 14 229 |
| ELD-CPD | EB1-PTD4 | 10 | 5 | 1 | 178 000 ± 11 934 |
|  |  |  |  | 2 | 277 476 ± 25 319 |
|  |  |  |  | 5 | 376 555 ± 16 075 |
| His-ELD-CPD-His | His-CM18-PTD4-His | 10 | 5 | 1 | 204 338 ± 22 673 |
|  |  |  |  | 2 | 307 329 ± 19 618 |
|  |  |  |  | 5 | 619 964 ± 17 411 |

The shuttle agent CM18-PTD4 was used as a model to demonstrate the modular nature of the individual protein domains, as well as their ability to be modified. More particularly, the presence or absence of: an N-terminal cysteine residue ("Cys"); different flexible linkers between the ELD and CPD domains ("L1": GGS; "L2": GGSGGGS (SEQ ID NO: 10 243); and "L3": GGSGGGSGGGS (SEQ ID NO: 10 244)) and different lengths, positions, and variants to histidine-rich domains; were studied.

HeLa cells were cultured and tested in the protein transduction assays using Protocol B as described in Example 9.1. Briefly, GFP-NLS recombinant protein (5 µM; see Example 5.1) was co-incubated with 20 µM of different shuttle peptide variants (see Table 1.3 for amino acid sequences and properties) of the shuttle agent His-CM18-PTD4 for 1 minute. After the final washing step, the cells were subjected to flow cytometry analysis as described in Example 3.3. Results are shown in Table 10.3e and FIG. 29I. "Pos cells (%)" is the mean percentages of all cells that emanate a GFP signal. The negative control ("Ctrl") corresponds to cells that were incubated with GFP-NLS recombinant protein (5 µM) without any shuttle agent.

TABLE 10.3e

Figure 29I:
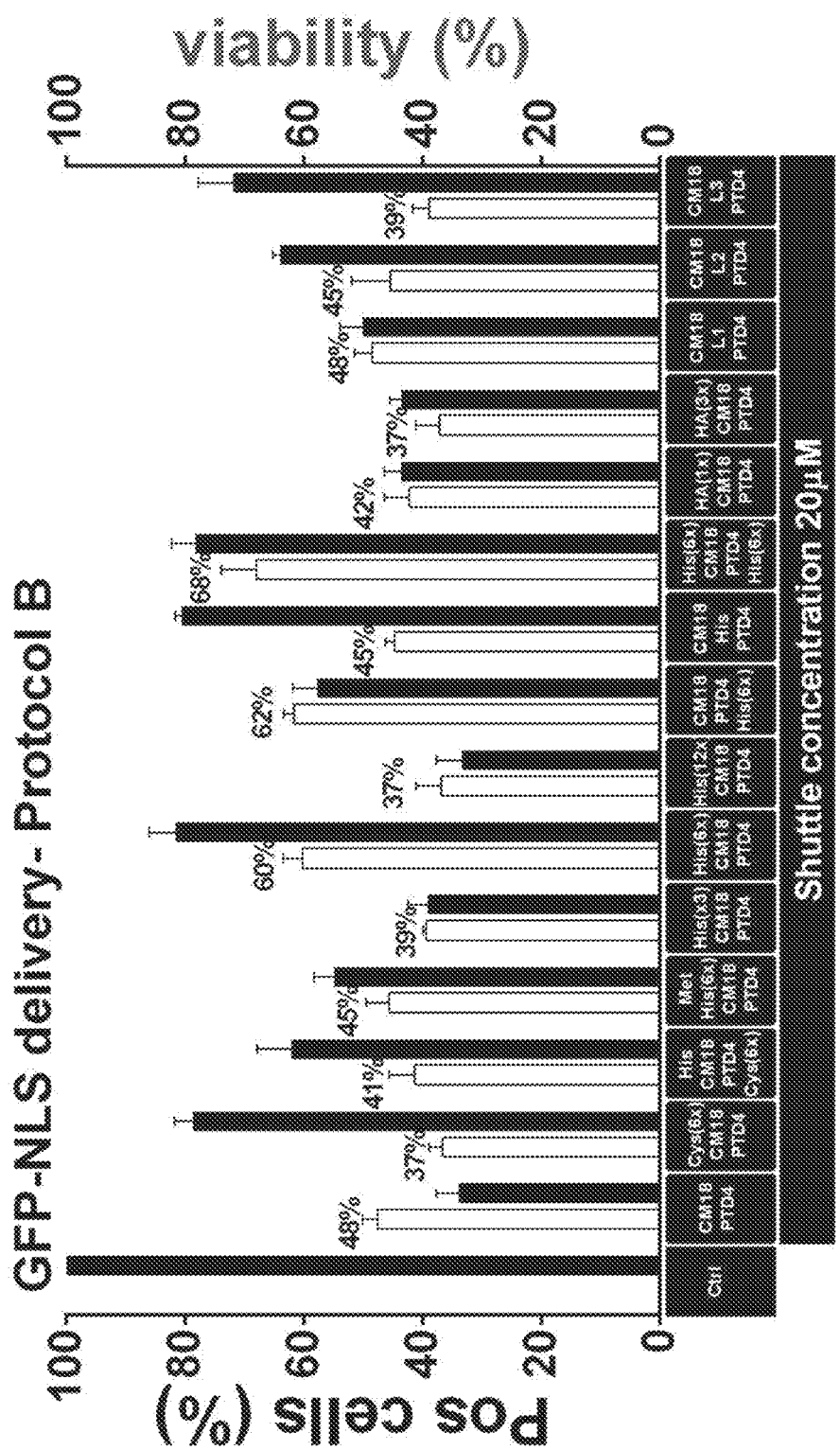
Figure 30A:
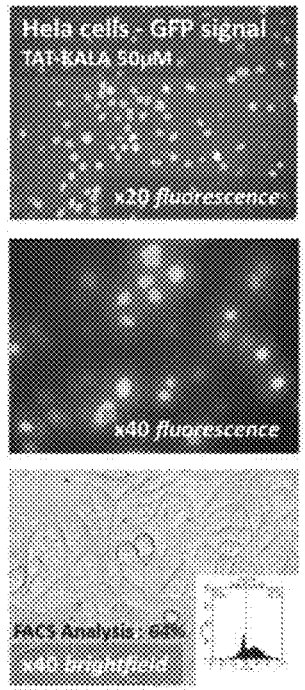
FIGS. 30A-30F show microscopy images of HeLa cells transduced with GFP-NLS using the shuttle agent
Figure 30B:
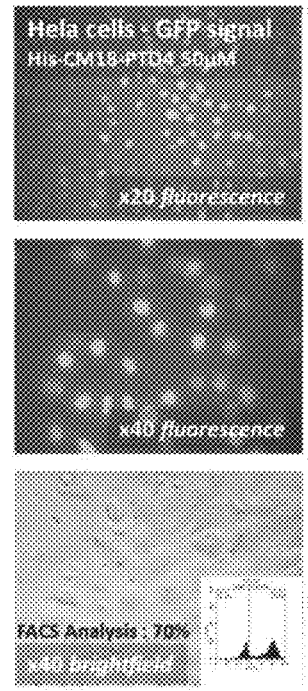
Figure 30C:
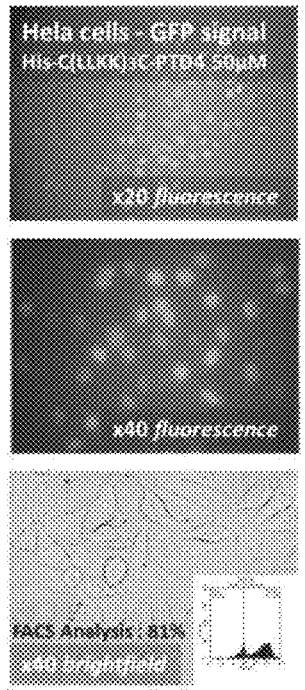
Figure 30D:
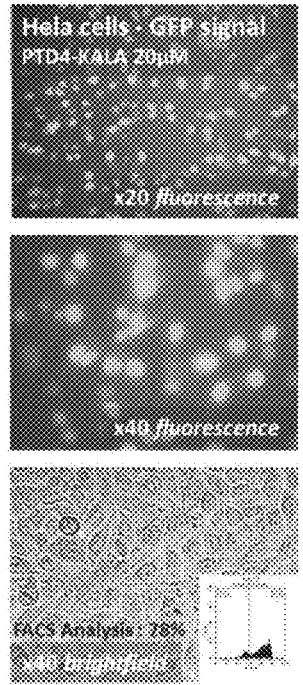
Figure 30E:
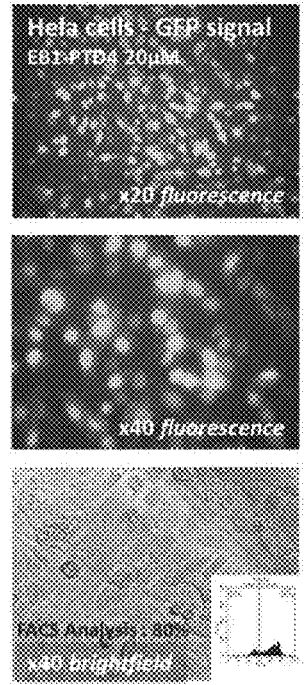
Figure 30F:
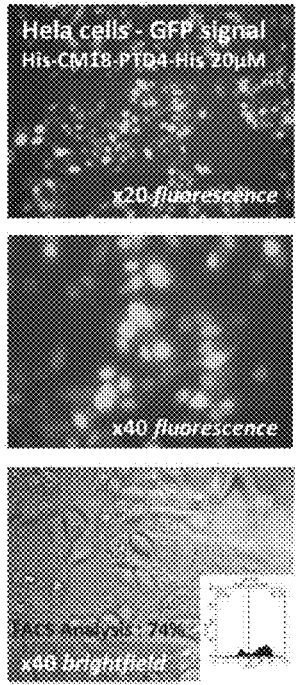

Data from FIG. 29I

| Domain structure | Shuttle agent | Conc. of shuttle (µM) | Conc. of GFP-NLS (µM) | Mean % cells with GFP signal (±St Dev.; n = 3) | Cell viability (%) (±St. Dev.; n = 3) |
|---|---|---|---|---|---|
| — | No shuttle ("Ctrl") | 0 | 5 | 0 | 99.6 ± 0.12 |
| ELD-CPD | CM18-PTD4 |  |  | 47.6 ± 2.6 | 33.9 ± 3.7 |
|  | Cys-CM18-PTD4 |  |  | 36.6 ± 2.3 | 78.7 ± 3.1 |
|  | CM18-L1-PTD4 | 20 | 5 | 48.5 ± 3.0 | 50.1 ± 3.8 |
|  | CM18-L2-PTD4 |  |  | 45.5 ± 6.5 | 64.0 ± 1.3 |
|  | CM18-L3-PTD4 |  |  | 39.0 ± 2.7 | 71.9 ± 6.0 |
| His-ELD-CPD | His-CM18-PTD4 | 20 | 5 | 60.3 ± 3.2 | 81.6 ± 4.5 |
|  | His-CM18-PTD4-6Cys |  |  | 41.3 ± 4.28 | 62 ± 5.76 |
|  | Met-His-CM18-PTD4-Cys |  |  | 45.6 ± 3.88 | 54.9 ± 3.45 |

TABLE 10.3e-continued

Data from FIG. 29I

| Domain structure | Shuttle agent | Conc. of shuttle (µM) | Conc. of GFP-NLS (µM) | Mean % cells with GFP signal (±St Dev.; n = 3) | Cell viability (%) (±St. Dev.; n = 3) |
|---|---|---|---|---|---|
|  | 3His-CM18-PTD4 |  |  | 39.4 ± 0.5 | 39.2 ± 3.3 |
|  | 12His-CM18-PTD4 |  |  | 36.9 ± 4.3 | 33.4 ± 4.3 |
|  | HA-CM18-PTD4 |  |  | 42.3 ± 4.2 | 68.3 ± 4.1 |
|  | 3HA-CM18-PTD4 |  |  | 37.2 ± 3.9 | 43.6 ± 2.8 |
| ELD-His-CPD | CM18-His-PTD4 | 20 | 5 | 61.7 ± 1.8 | 57.7 ± 4.2 |
| His-ELD-CPD-His | His-CM18-PTD4-His | 20 | 5 | 68.0 ± 6.0 | 78.6 ± 1.1 |

These results show that variations in a given shuttle (e.g., CM18-PTD4) may be used to modulate the degree of transduction efficiency and cell viability of the given shuttle. More particularly, the addition of an N-terminal cysteine residue to CM18-PTD4 (see Cys-CM18-PTD4), decreased GFP-NLS transduction efficiency by 11% (from 47.6% to 36.6%), but increased cell viability from 33.9% to 78.7%. Introduction of flexible linker domains (L1, L2, and L3) of different lengths between the CM18 and PTD4 domains did not result in a dramatic loss of transduction efficiency, but increased cell viability (see CM18-L1-PTD4, CM18-L2-PTD4, and CM18-L3-PTD4). Finally, variations to the amino acid sequences and/or positions of the histidine-rich domain(s) did not result in a complete loss of transduction efficiency and cell viability of His-CM18-PTD4 (see 3His-CM18-PTD4, 12His-CM18-PTD4, HA-CM18-PTD4, 3HA-CM18-PTD4, CM18-His-PTD4, and His-CM18-PTD4-His). Of note, adding a second histidine-rich domain at the C terminus of His-CM18-PTD4 (i.e., His-CM18-PTD4-His) increased transduction efficiency from 60% to 68% with similar cell viability.

10.5 Lack of GFP-NLS Transduction by Single-Domain Peptides or a his-CPD Peptide in HeLa Cells: Flow Cytometry HeLa cells were cultured and tested in the protein transduction assays using Protocol B as described in Example 9.1. Briefly, GFP-NLS recombinant protein (5 µM; see Example 5.1) was co-incubated with 50 µM of different single-domain peptides (TAT; PTD4; Penetratin; CM18; C(LLKK)₃C; KALA) or the two-domain peptide His-PTD4 (lacking an ELD), and exposed to the HeLa cells for 10 seconds. After the final washing step, the cells were subjected to flow cytometry analysis as described in Example 3.3. Results are shown in Table 10.4 and FIG. 29D. "Pos cells (%)" is the mean percentages of all cells that emanate a GFP signal. The negative control ("Ctrl") corresponds to cells that were incubated with GFP-NLS recombinant protein (5 µM) without any single-domain peptide or shuttle agent.

TABLE 10.4

Data from FIG. 29D

| Protocol | Domain | Single-domain peptide | Cells | Conc. of shuttle (μM) | Conc. of GFP-NLS (μM) | Mean % cells with GFP signal (±St. Dev.; n = 3) | Cell viability (%) (±St. Dev.; n = 3) |
|---|---|---|---|---|---|---|---|
| B | — | No peptide ("Ctrl") | HeLa | 0 | 5 | 0.1 ± 0.02 | 98.3 ± 0.59 |
| | CPD | TAT | HeLa | 50 | 5 | 1.1 ± 0.27 | 94.6 ± 0.44 |
| | | PTD4 | | | | 1.1 ± 0.06 | 94 ± 4.5 |
| | | Penetratin (Pen) | | | | 3.6 ± 0.1 | 96 ± 0.6 |
| | ELD | CM18 | HeLa | 50 | 5 | 2.9 ± 0.2 | 95 ± 1.2 |
| | | C(LLKK)$_3$C | | | | 1.1 ± 0.57 | 61.8 ± 0.1 |
| | | KALA | | | | 1.4 ± 0.13 | 84 ± 0.7 |
| | His-CPD | His-PTD4 | HeLa | 50 | 5 | 1.04 ± 0.12 | 96.5 ± 0.28 |

These results show that the single-domain peptides TAT, PTD4, Penetratin, CM18, C(LLKK)$_3$C, KALA, or the two-domain peptide His-PTD4 (lacking an ELD), are not able to successfully transduce GFP-NLS in HeLa cells.

10.6 GFP-NLS Transduction by TAT-KALA, his-CM18-PTD4, his-C(LLKK)$_3$C-PTD4, PTD4-KALA, EB1-Ptd4, and his-CM18-PTD4-his in HeLa Cells: Visualization by Microscopy GFP-NLS recombinant protein (5 μM; see Example 5.1) was co-incubated with 50 μM of shuttle agent, and then exposed to HeLa cells for 10 seconds using Protocol B as described in Example 9.1. The cells were visualized by microscopy as described in Example 3.2, after an incubation time of 2 minutes.

For the sample results shown in FIG. 30, GFP fluorescence of the HeLa cells was immediately visualized by bright field (bottom row panels) and fluorescence (upper and middle row panels) microscopy at 20× or 40× magnifications after the final washing step. The results with the shuttle agents TAT-KALA, His-CM18-PTD4, and His-C(LLKK)$_3$C-PTD4 are shown in FIGS. 30A, 30B and 30C, respectively. The results with the shuttle agents PTD4-KALA, EB1-PTD4, and His-CM18-PTD4-His are shown in FIGS. 30D, 30E and 30F, respectively. The insets in the bottom row panels show the results of corresponding FACS analyses (performed as described in Example 3.3), which indicates the percentage of cells in a 96-plate well with a GFP signal. No significant cellular GFP fluorescence was observed in negative control samples (i.e., cells exposed to GFP-NLS without any shuttle agent; data not shown).

10.7 GFP-NLS Transduction by TAT-KALA, his-CM18-PTD4 and his-C(LLKK)$_3$C-PTD4 with Varying Incubation Times in THP-1 Cells: Flow Cytometry THP-1 cells were cultured and tested in the protein transduction assays using Protocol C as described in Example 9.1. Briefly, GFP-NLS recombinant protein (5 μM; see Example 5.1) was co-incubated with 1 μM of TAT-KALA, His-CM18-PTD4, or His-C(LLKK)$_3$C-PTD4 for 15, 30, 60, or 120 seconds. After the final washing step, the cells were subjected to flow cytometry analysis as described in Example 3.3. The mean percentages of cells emanating a GFP signal ("Pos cells (%)") are shown in Table 10.4a and in FIG. 34A. The mean fluorescence intensity is shown in Table 10.5 and FIG. 34B. The negative control ("Ctrl") corresponds to cells that were incubated with GFP-NLS recombinant protein (5 (M) without any shuttle agent.

TABLE 10.4a

Figure 34A:
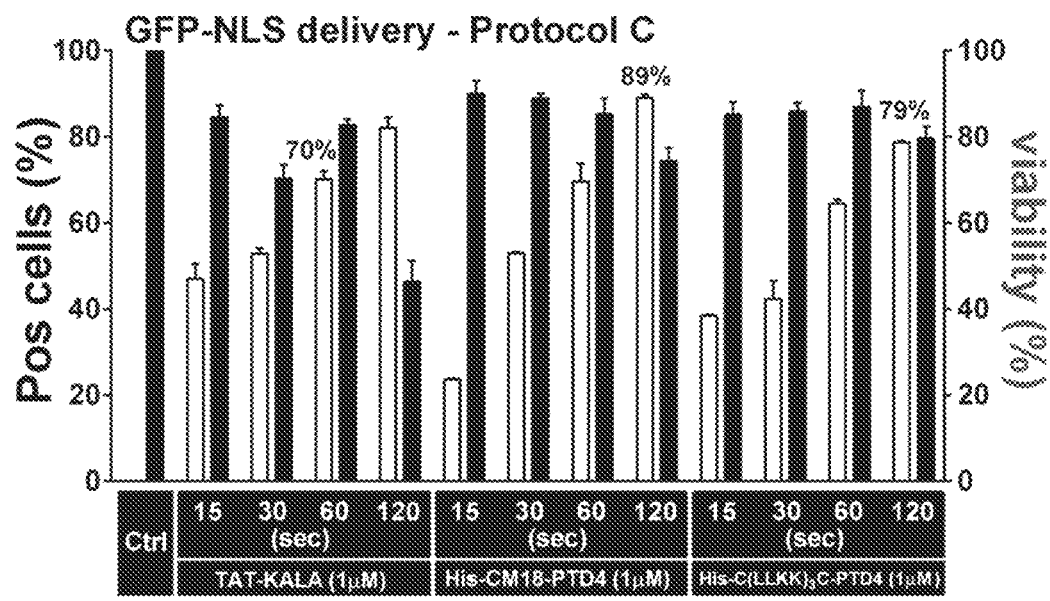
FIGS. 34A-34B show the results of GFP-NLS transduction efficiency experiments in THP-1 cells using the shuttle TAT-KALA, His-CM18-PTD4, or His-C(LLKK)$_3$C-PTD4. The cargo protein/shuttle agents were exposed to the THP-1 cells for 15, 30, 60 or 120 seconds. GFP-NLS transduction efficiency was evaluated by flow cytometry and the percentage of GFP fluorescent cells ("Pos cells (%)"), as well as corresponding cell viability data ("viability (%)") are shown in FIG. 34A.

Data from FIG. 34A

| Protocol | Shuttle agent | Cells | Conc. of shuttle (μM) | Conc. of GFP-NLS (μM) | Incubation time (sec.) | Mean % cells with GFP signal (±St. Dev.; n = 3) | Cell viability (%) (±St. Dev.; n = 3) |
|---|---|---|---|---|---|---|---|
| C | No shuttle ("Ctrl") | THP-1 | 0 | 5 | 120 | 1.12 ± 0.27 | 97.3 ± 1.55 |
| | TAT-KALA | THP-1 | 1 | 5 | 15 | 47 ± 3.5 | 84.6 ± 2.7 |
| | | | | | 30 | 52.9 ± 1.3 | 70.3 ± 3.2 |
| | | | | | 60 | 70.1 ± 2.0 | 82.7 ± 1.4 |
| | | | | | 120 | 82.1 ± 2.5 | 46.3 ± 4.9 |
| | His-CM18-PTD4 | THP-1 | 1 | 5 | 15 | 23.7 ± 0.2 | 90 ± 3.0 |
| | | | | | 30 | 53 ± 0.3 | 89 ± 1.1 |
| | | | | | 60 | 69.6 ± 4.2 | 85.3 ± 3.6 |
| | | | | | 120 | 89 ± 0.8 | 74.3 ± 3.2 |
| | His-C(LLKK)$_3$C-PTD4 | THP-1 | 1 | 5 | 15 | 38.4 ± 0.3 | 85.2 ± 2.8 |
| | | | | | 30 | 42.3 ± 4.2 | 86 ± 2.0 |
| | | | | | 60 | 64.5 ± 1.0 | 86.9 ± 3.8 |
| | | | | | 120 | 78.7 ± 0.3 | 79.6 ± 2.8 |

TABLE 10.5

Figure 34B:
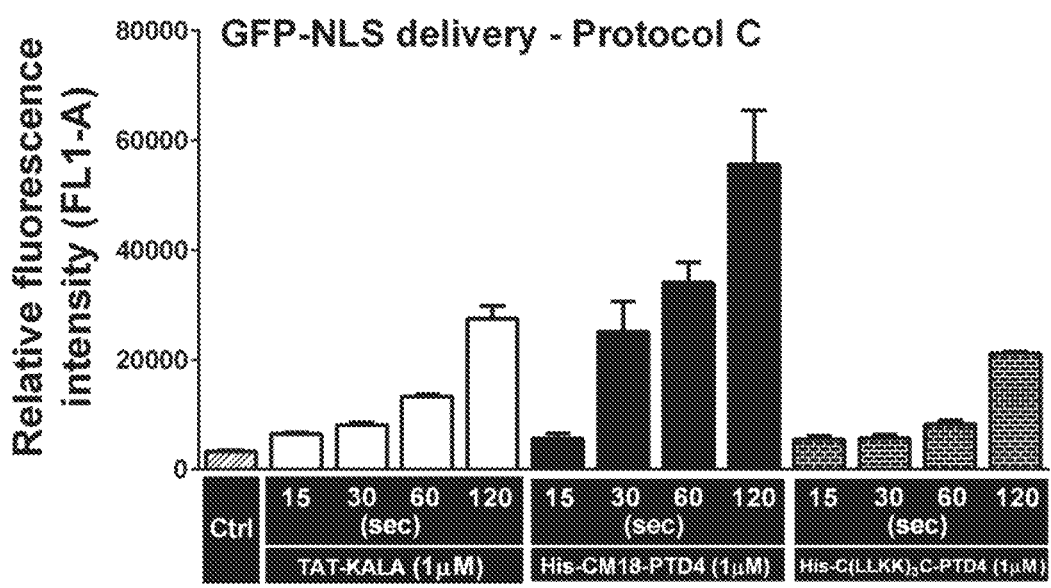

Data from FIG. 34B

| Protocol | Shuttle agent | Cells | Conc. of shuttle (µM) | Incubation time (sec.) | Relative fluorescence intensity (FL1-A) (n = 3) | Standard Deviation |
|---|---|---|---|---|---|---|
| C | No shuttle ("Ctrl") | THP-1 | 0 | 120 | 217 | 23.09 |
|   | TAT-KALA | THP-1 | 1 | 15 | 6 455.12 | 333.48 |
|   |   |   |   | 30 | 8 106.81 | 436.28 |
|   |   |   |   | 60 | 13 286.2 | 463.96 |
|   |   |   |   | 120 | 27 464.92 | 2 366.48 |
|   | His-CM18-PTD4 | THP-1 | 1 | 15 | 5 605.45 | 933.16 |
|   |   |   |   | 30 | 25 076.41 | 5 567.33 |
|   |   |   |   | 60 | 34 046.94 | 3 669.19 |
|   |   |   |   | 120 | 55 613.48 | 9 836.84 |
|   | His-C(LLKK)$_3$C-PTD4 | THP-1 | 1 | 15 | 5 475.12 | 693.29 |
|   |   |   |   | 30 | 5 755.8 | 635.18 |
|   |   |   |   | 60 | 8 267.38 | 733.29 |
|   |   |   |   | 120 | 21 165.06 | 209.37 |

Example 11

Repeated Daily Treatments with Low Concentrations of Shuttle Agent in the Presence of Serum Results in GFP-NLS Transduction in THP-1 Cells 11.1 GFP-NLS Transduction with his-CM18-PTD4 or his-C(LLKK)3C-PTD4 in THP-1 Cells: Flow Cytometry THP-1 cells were cultured and tested in the protein transduction assay using Protocol A as described in Example 9.1, but with the following modifications. GFP-NLS recombinant protein (5, 2.5, or 1 µM; see Example 5.1) was co-incubated with 0.5 or 0.8 µM of His-CM18-PTD4, or with 0.8 µM of His-C(LLKK)$_3$C-PTD4, and then exposed to THP-1 cells each day for 150 min in the presence of cell culture medium containing serum. Cells were washed and subjected to flow cytometry analysis as described in Example 3.3 after 1 or 3 days of repeated exposure to the shuttle agent/cargo. The results are shown in Table 11.1 and in FIGS. 35A, 35B, 35C and 35F. The negative control ("Ctrl") corresponds to cells that were incubated with GFP-NLS recombinant protein (5 µM) without any shuttle agent.

TABLE 11.1

Data from FIG. 35A, 35B, 35C and 35F

| FIG. | Shuttle agent | Cells | Conc. of shuttle (µM) | Conc. of GFP-NLS (µM) | Exposure to shuttle/cargo (days) | Mean % cells with GFP signal (±St. Dev.; n = 3) | Cell viability (%) (±St. Dev.; n = 3) |
|---|---|---|---|---|---|---|---|
| 35A | No shuttle (Ctrl) | THP-1 | 0 | 5 | 0 | 0.15 ± 0.04 | 98.7 ± 0.1 |
|   | His-CM18-PTD4 |   | 0.5 | 5 | 1 | 12.1 ± 1.5 | 98.2 ± 2.4 |
|   |   |   |   |   | 3 | 73.4 ± 1.1 | 84.3 ± 3.8 |
| 35B | No shuttle (Ctrl) | THP-1 | 0 | 5 | 0 | 0.36 ± 0.09 | 97.1 ± 1.2 |
|   | His-CM18-PTD4 |   | 0.8 | 2.5 | 1 | 12.2 ± 0.9 | 92.3 ± 1.9 |
|   |   |   |   |   | 3 | 62.4 ± 3.5 | 68.5 ± 2.2 |
| 35C | No shuttle (Ctrl) | THP-1 | 0 | 5 | 0 | 0.28 ± 0.05 | 96.4 ± 2.0 |
|   | His-CM18-PTD4 |   | 0.8 | 1 | 1 | 1.6 ± 0.2 | 98.4 ± 6.4 |
|   |   |   |   |   | 3 | 6.5 ± 0.9 | 80.6 ± 4.6 |
| 35F | No shuttle (Ctrl) | THP-1 | 0 | 5 | 0 | 0.62 ± 0.11 | 96.3 ± 1.4 |
|   | His-C(LLKK)$_3$C-PTD4 |   | 0.8 | 1 | 1 | 1.8 ± 0.2 | 97.2 ± 2.2 |
|   |   |   |   |   | 3 | 6.6 ± 0.8 | 76.6 ± 3.4 |

The viability of THP-1 cells repeatedly exposed to His-CM18-PTD4 and GFP-NLS was determined as described in Example 3.3a. The results are shown in Tables 11.2 and 11.3 and in FIGS. 35D and 35E. The results in Table 11.2 and FIG. 35D show the metabolic activity index of the THP-1 cells after 1, 2, 4, and 24 h, and the results in Table 11.3 and FIG. 35E show the metabolic activity index of the THP-1 cells after 1 to 4 days.

TABLE 11.2

Data from FIG. 35D

| Shuttle agent | Cells | Conc. of shuttle (µM) | Conc. of GFP-NLS (µM) | Mean metabolic activity index (±St. Dev.; n = 3) (Exposure to shuttle/cargo) | | | |
|---|---|---|---|---|---|---|---|
|   |   |   |   | 1 h | 2 h | 4 h | 24 h |
| No shuttle (Ctrl) | THP-1 | 0 | 5 | 40810 ± 757.39 | 38223 ± 238.66 | 44058 ± 320.23 | 42362 ± 333.80 |
| His-CM18-PTD4 | THP-1 | 0.5 | 5 | 9974 ± 1749.85 | 9707 ± 1259.82 | 3619 ± 2247.54 | 2559 ± 528.50 |
|   |   | 1 | 5 | 42915 ± 259.67 | 41386 ± 670.66 | 44806 ± 824.71 | 43112 ± 634.56 |

TABLE 11.3

Data from FIG. 35E

| Shuttle agent | Cells | Conc. of shuttle (μM) | Conc. of GFF-NLS (μM) | Mean metabolic activity index (±St. Dev.; n = 3) (Exposure to shuttle/cargo) | | | |
|---|---|---|---|---|---|---|---|
| | | | | 1 day | 2 days | 3 days | 4 days |
| No shuttle (Ctrl) | THP-1 | 0 | 5 | 44684 ± 283.27 | 43389 ± 642.47 | 45312 ± 963.40 | 43697 ± 1233 |
| | | 0.5 | 5 | 44665 ± 310.3 | 42664 ± 398.46 | 43927 ± 3511.54 | 43919 ± 4452.25 |
| His-CM184FTD4 | THP-1 | 0.8 | 5 | 44531 ± 176.66 | 43667 ± 421.66 | 44586 ± 383.68 | 44122 ± 239.98 |
| | | 1 | 5 | 41386 ± 670.66 | 36422 ± 495.01 | 27965 ± 165.33 | 22564 ± 931.28 |

The results in Example 11 show that repeated daily (or chronic) treatments with relatively low concentrations of His-CM18-PTD4 or His-C(LLKK)$_3$C-PTD4 in the presence of serum result in intracellular delivery of GFP-NLS in THP-1 cells. The results also suggest that the dosages of the shuttle agents and the cargo can be independently adjusted to improve cargo transduction efficiency and/or cell viability.

Example 12

His-CM18-PTD4 Increases Transduction Efficiency and Nuclear Delivery of GFP-NLS in a Plurality of Cell Lines 12.1 GFP-NLS Transduction with his-CM18-PTD4 in Different Adherent & Suspension Cells: Flow Cytometry The ability of the shuttle agent His-CM18-PTD4 to deliver GFP-NLS to the nuclei of different adherent and suspension cells using Protocols B (adherent cells) or C (suspension cells) as described in Example 9.1 was examined. The cell lines tested included: HeLa, Balb3T3, HEK 293T, CHO, NIH3T3, Myoblasts, Jurkat, THP-1, CA46, and HT2 cells, which were cultured as described in Example 1. GFP-NLS (5 μM; see Example 5.1) was co-incubated with 35 μM of His-CM18-PTD4 and exposed to adherent cells for 10 seconds (Protocol B), or was co-incubated with 5 μM of His-CM18-PTD4 and exposed to suspension cells for 15 seconds (Protocol C). Cells were washed and subjected to flow cytometry analysis as described in Example 3.3. Results are shown in Table 12.1 and FIG. 36. "Pos cells (%)" is the mean percentages of all cells that emanate a GFP signal.

TABLE 12.1

Figure 36:
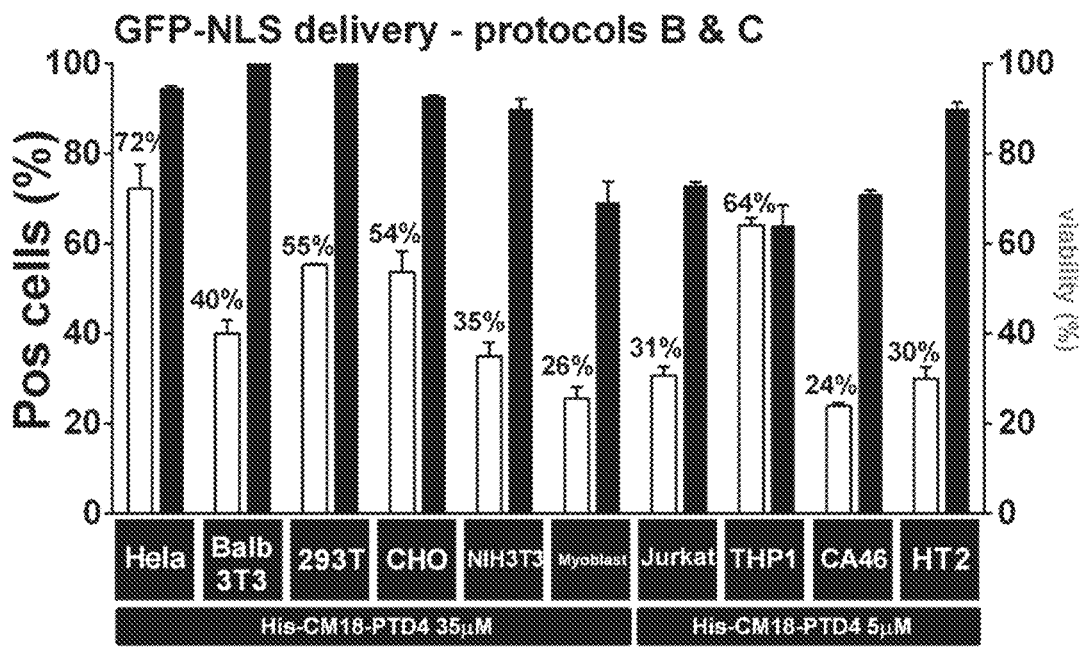
FIG. 36 shows a comparison of the GFP-NLS transduction efficiencies in a plurality of different types of cells (e.g., adherent and suspension, as well as cell lines and primary cells) using the shuttle His-CM18-PTD4, as measured by flow cytometry. The results are expressed as the percentage of GFP fluorescent cells ("Pos cells (%)"), as well as corresponding cell viability data ("viability (%)").

Data from FIG. 36

| Shuttle agent | Protocol | Conc. of shuttle (μM) | Conc. of GFP-NLS (μM) | Cells | Mean % cells with GFP signal (±St. Dev.; n = 3) | Cell viability (%) (±St. Dev.; n = 3) |
|---|---|---|---|---|---|---|
| His-CM18-PTD4 | B | 35 | 5 | HeLa | 72.3 ± 5.3 | 94.6 ± 0.4 |
| | | | | Balb3T3 | 40.2 ± 3.1 | 98.4 ± 0.6 |
| | | | | HEK 293T | 55.3 ± 0.2 | 95.3 ± 1.2 |
| | | | | CHO | 53.7 ± 4.6 | 92.8 ± 0.1 |
| | | | | NIH3T3 | 35.4 ± 3.9 | 3.3 ± 5.4 |
| | | | | Myoblasts | 25.6 ± 2.6 | 23.5 ± 1.1 |
| | C | 5 | 5 | Jurkat | 30.7 ± 2.2 | 73.6 ± 0.7 |
| | | | | THP-1 | 64.1 ± 1.6 | 64.1 ± 4.5 |
| | | | | CA46 | 24.4 ± 0.6 | 71.6 ± 1.0 |
| | | | | HT2 | 30.5 ± 2.5 | 90.6 ± 1.5 |

TABLE 12.1

Data from FIG. 36

| Shuttle agent | Protocol | Conc. of shuttle (μM) | Conc. of GFP-NLS (μM) | Cells | Mean % cells with GFP signal (±St. Dev.; n = 3) | Cell viability (%) (±St. Dev.; n = 3) |
|---|---|---|---|---|---|---|
| His-CM18-PTD4 | B | 35 | 5 | HeLa | 72.3 ± 5.3 | 94.6 ± 0.4 |
| | | | | Balb3T3 | 40.2 ± 3.1 | 98.4 ± 0.6 |
| | | | | HEK 293T | 55.3 ± 0.2 | 95.3 ± 1.2 |
| | | | | CHO | 53.7 ± 4.6 | 92.8 ± 0.1 |
| | | | | NIH3T3 | 35.4 ± 3.9 | 3.3 ± 5.4 |
| | | | | Myoblasts | 25.6 ± 2.6 | 23.5 ± 1.1 |
| | C | 5 | 5 | Jurkat | 30.7 ± 2.2 | 73.6 ± 0.7 |
| | | | | THP-1 | 64.1 ± 1.6 | 64.1 ± 4.5 |
| | | | | CA46 | 24.4 ± 0.6 | 71.6 ± 1.0 |
| | | | | HT2 | 30.5 ± 2.5 | 90.6 ± 1.5 |

Figure 37A:
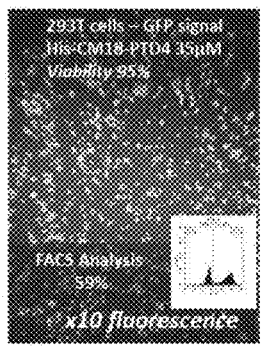
FIGS. 37A-37H show fluorescence microscopy images of different types of cells transduced with GFP-NLS cargo using the shuttle His-CM18-PTD4. GFP fluorescence was visualized by fluorescence microscopy at a 10× magnification. The results of parallel flow cytometry experiments are also provided in the insets (viability and percentage of GFP-fluorescing cells).
Figure 37B:
Figure 37C:
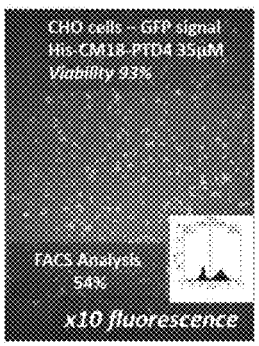
Figure 37D:
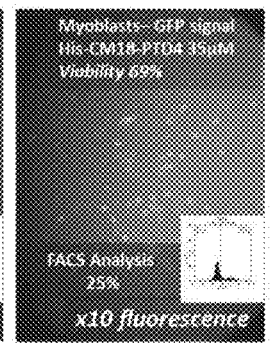
Figure 37E:
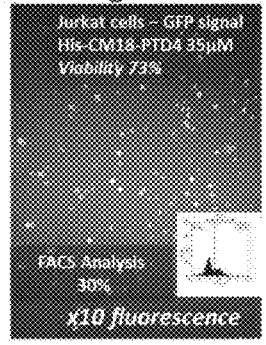
Figure 37F:
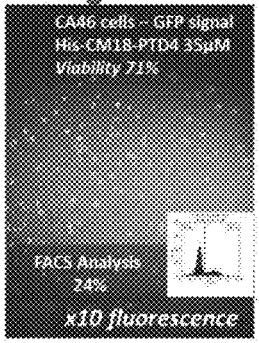
Figure 37G:
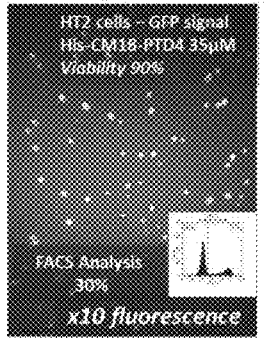
Figure 37H:
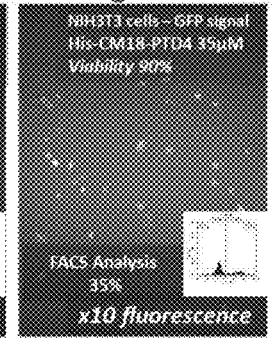

12.2 GFP-NLS Transduction with his-CM18-PTD4 in Several Adherent and Suspension Cells: Visualization by Microscopy GFP-NLS recombinant protein (5 μM; see Example 5.1) was co-incubated with 35 μM of His-CM18-PTD4 and exposed to adherent cells for 10 seconds using Protocol A, or was co-incubated with 5 μM of His-CM18-PTD4 and exposed to suspension cells for 15 seconds using Protocol B, as described in Example 9.1. After washing the cells, GFP fluorescence was visualized by bright field and fluorescence microscopy. Sample images captured at 10× magnifications showing GFP fluorescence are shown for 293T (FIG. 37A), Balb3T3 (FIG. 37B), CHO (FIG. 37C), Myoblasts (FIG. 37D), Jurkat (FIG. 37E), CA46 (FIG. 37F), HT2 (FIG. 37G), and NIH3T3 (FIG. 37H) cells. The insets show corresponding flow cytometry results performed as described in Example 3.3, indicating the percentage of GFP-NLS-positive cells. No significant cellular GFP fluorescence was observed in negative control samples (i.e., cells exposed to GFP-NLS without any shuttle agent; data not shown).

Figure 38A:
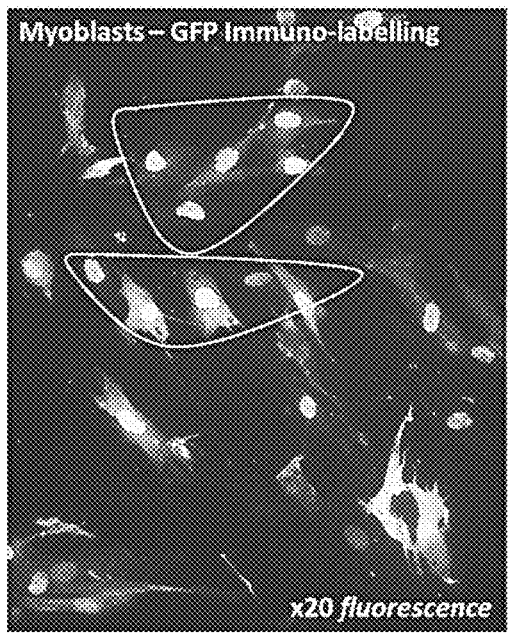
FIGS. 38A-38B show fluorescence microscopy images of primary human myoblasts transduced with GFP-NLS using the shuttle His-CM18-PTD4. Cells were fixed and permeabilized prior to immuno-labelling GFP-NLS with an anti-GFP antibody and a fluorescent secondary antibody. Immuno-labelled GFP is shown in FIG. 38A, and this image is overlaid with nuclei (DAPI) labelling in FIG. 38B.
Figure 38B:
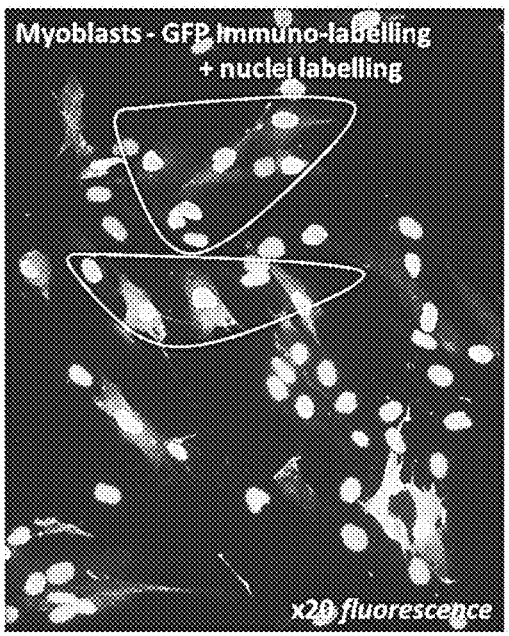

Nuclear localization of the GFP-NLS was further confirmed in fixed and permeabilized myoblasts using cell immuno-labelling as described in Example 3.2a. GFP-NLS was labeled using a primary mouse monoclonal anti-GFP antibody (Feldan, #A017) and a secondary goat anti-mouse Alexa™-594 antibody (Abcam #150116). Nuclei were labelled with DAPI. Sample results for primary human myoblast cells are shown in FIG. 38, in which GFP immuno-labelling is shown in FIG. 38A, and an overlay of the GFP immuno-labelling and DAPI labelling is shown in FIG. 38B. No significant cellular GFP labelling was observed in negative control samples (i.e., cells exposed to GFP-NLS without any shuttle agent; data not shown).

The microscopy results revealed that GFP-NLS is successfully delivered to the nucleus of all the tested cells using the shuttle agent His-CM18-PTD4.

Example 13

His-CM18-PTD4 Enables Transduction of a CRISPRICas9-NLS System and Genome Editing in Hela Cells 13.1 Cas9-NLS Recombinant Protein Cas9-NLS recombinant protein was constructed, expressed and purified from a bacterial expression system as described in Example 1.4. The sequence of the Cas9-NLS recombinant protein produced was:

[SEQ ID NO: 74]
MDKKYSIGLDIGTNSVGWAVITDEYKVPSKKFKVLGNTDRHSIKKNLIGAL
LFDSGETAEATRLKRTARRRYTRRKNRICYLQEIFSNEMAKVDDSFFHRLE
ESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKSN
FDLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSKN
GYAGYIDGGASQEEFYKFIKPILEKMDGTEELLVKLNREDLLRKQRTFDNG
SIPHQIHLGELHAILRRQEDFYPFLKDNREKIEKILTFRIPYYVGPLARGN
SRFAWMTRKSEETITPWNFEEVVDKGASAQSFIERMTNFDKNLPNEKVLPK
HSLLYEYFTVYNELTKVKYVTEGMRKPAFLSGEQKKAIVDLLFKTNRKVTV
KQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMAR
ENQTTQKGQKNSRERMKRIEEGIKELGSQILKEHPVENTQLQNEKLYLYYL
QNGRDMYVDQELDINRLSDYDVDHIVPQSFLKDDSIDNKVLTRSDKNRGKS
DNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKD
FQFYKVREINNYHHAHDAYLNAVVGTALIKKYPKLESEFVYGDYKVYDVRK
MIAKSEQEIGKATAKYFFYSNIMNFFKTEITLANGEIRKRPLIETNGETGE
IVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSS
FEKNPIDFLEAKGYKEVKKDLIIKLPKYSLFELENGRKRMLASAGELQKGN

```
ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGDGGRSSDDEA

TADSQHAAPPKKKRKVGGSGGGSGGGSGGGRHHHHHH
(MW = 162.9 kDa; pI = 9.05)
NLS sequence is underlined
Serine/glycine rich linkers are in bold
```

13.2 Transfection Plasmid Surrogate Assay

Figure 39A:
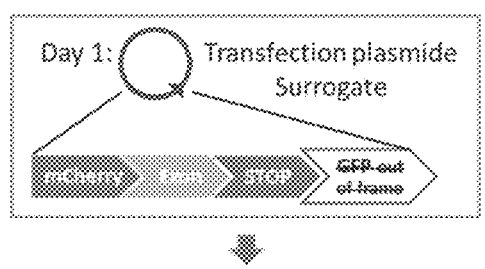
FIGS. 39A-39E show a schematic layout (FIGS. 39A, 39B and 39C) and sample fluorescence images (FIGS. 39D and 39E) of a transfection plasmid surrogate assay used to evaluate the activity of intracellularly delivered CRISPR/Cas9-NLS complex. At Day 1 (FIG. 39A), cells are transfected with an expression plasmid encoding the fluorescent proteins mCherry™ and GFP, with a STOP codon separating their two open reading frames. Transfection of the cells with the expression plasmid results in only mCherry™ expression (FIG. 39D). A CRISPR/Cas9-NLS complex, which has been designed/programmed to cleave the plasmid DNA at the STOP codon, is then delivered intracellularly to the transfected cells expressing mCherry™, resulting double-stranded cleavage of the plasmid DNA at the STOP codon (FIG. 39B). In a fraction of the cells, random non-homologous DNA repair of the cleaved plasmid occurs and results in removal of the STOP codon (FIG. 39C), and thus GFP expression and fluorescence (FIG. 39E). White triangle windows indicate examples of areas of co-labelling of mCherry™ and GFP fluorescence.
Figure 39B:
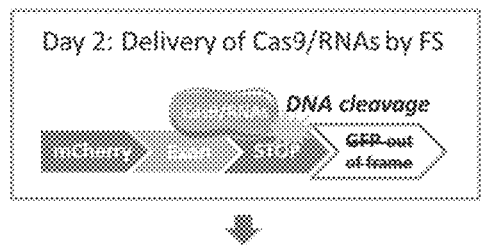
Figure 39C:
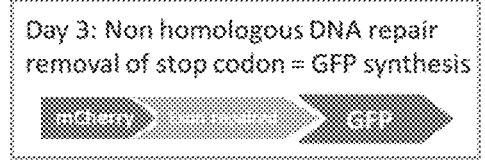
Figure 39D:
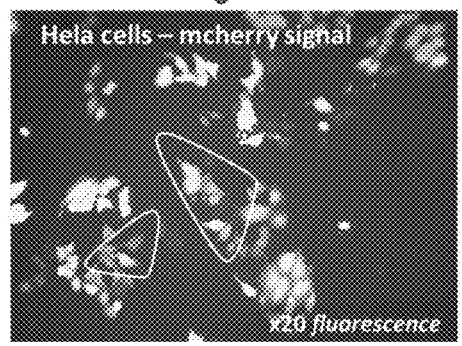
Figure 39E:
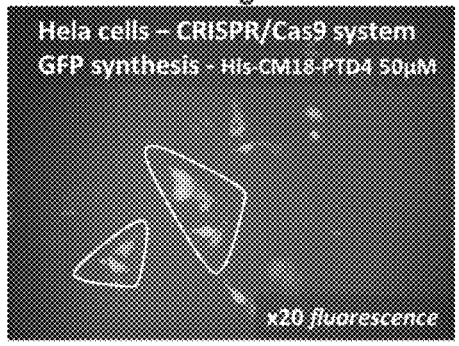

This assay enables one to visually identify cells that have been successfully delivered an active CRISPRICas9 complex. As shown in FIG. 39A, the assay involves transfecting cells with an expression plasmid DNA encoding the fluorescent proteins mCherry™ and GFP, with a STOP codon separating their two open reading frames. Transfection of the cells with the expression plasmid results in mCherry™ expression, but no GFP expression (FIG. 39B). A CRISPR/Cas9 complex, which has been designed/programmed to cleave the plasmid DNA at the STOP codon, is then delivered intracellularly to the transfected cells expressing mCherry™ (FIG. 39D). Successful transduction of an active CRISPR/Cas9 complex results in the CRISPR/Cas9 complex cleaving the plasmid DNA at the STOP codon (FIG. 39C). In a fraction of the cells, random non-homologous DNA repair of the cleaved plasmid occurs and results in removal of the STOP codon, and thus GFP expression and fluorescence (FIG. 39E).

On Day 1 of the transfection plasmid surrogate assay, DNA plasmids for different experimental conditions (250 ng) are diluted in DMEM (50 µL) in separate sterile 1.5-mL tubes, vortexed and briefly centrifuged. In separate sterile 1.5-mL tubes, Fastfect™ transfection reagent was diluted in DMEM (50 µL) with no serum and no antibiotics at a ratio of 3:1 (3 µL of Fastfect™ transfection reagent for 1 µg of DNA) and then quickly vortexed and briefly centrifuged. The Fastfect™/DMEM mixture was then added to the DNA mix and quickly vortexed and briefly centrifuged. The Fastfect™/DMEM/DNA mixture is then incubated for 15-20 min at room temperature, before being added to the cells (100 µL per well). The cells are then incubated at 37° C. and 5% $CO_2$ for 5 h. The media is then changed for complete medium (with serum) and further incubated at 37° C. and 5% $CO_2$ for 24-48 h. The cells are then visualized under fluorescent microscopy to view the mCherry™ signal.

13.3 his-CM18-PTD4-Mediated CRISPR/Cas9-NLS System Delivery and Cleavage of Plasmid DNA RNAs (crRNA & tracrRNA) were designed to target a nucleotide sequence of the EMX1 gene, containing a STOP codon between the mCherry™ and GFP coding sequences in the plasmid of Example 13.2. The sequences of the crRNA and tracrRNA used were as follows:

```
crRNA [SEQ ID NO: 75]:
5'-GAGUCCGAGCAGAAGAAGAAGUUUUAGAGCUAUGCUGUUUUG-3' tracrRNA [SEQ ID NO: 76]:
5'-AAACAGCAUAGCAAGUUAAAAUAAGGCUAGUCCGUUAUCAACUUGAAA
AAGUGGCACCGAGUCGGUGCU-3'
```

HeLa cells were cultured and subjected to the transfection plasmid surrogate assay as described in Example 13.2). On Day 1, the HeLa cells were transfected with a plasmid surrogate encoding the mCherry™ protein as shown in FIG. 39A. On Day 2, a mix of Cas9-NLS recombinant protein (2 µM; see Example 13.1) and RNAs (crRNA & tracrRNA; 2 µM; see above) were co-incubated with 50 µM of His-CM18-PTD4, and the mixture (CRISPR/Cas9 complex) was exposed to HeLa cells for 10 seconds using Protocol B as described in Example 9.1. Double-stranded plasmid DNA cleavage by the CRISPR/Cas9 complex at the STOP codon between the mCherry™ and GFP coding sequences (FIG. 39B), and subsequent non-homologous repair by the cell in some cases results in removal of the STOP codon (FIG. 39C), thereby allowing expression of both the mCherry™ and GFP fluorescent proteins in the same cell on Day 3 (FIG. 39D-39E). White triangle windows in FIGS. 39D and 39E indicate examples of areas of co-labelling between mCherry™ and GFP.

As a positive control for the CRISPR/Cas9-NLS system, HeLa cells were cultured and co-transfected with three plasmids: the plasmid surrogate (as described in Example 13.2) and other expression plasmids encoding the Cas9-NLS protein (Example 13.1) and the crRNAltracrRNAs (Example 13.3). Typical fluorescence microscopy results are shown in FIGS. 40A-D. Panels A and B show cells 24 hours post-transfection, while panels C and D show cells 72 hours post-transfection.

FIG. 40E-40H shows the results of a parallel transfection plasmid surrogate assay performed using 35 µM of the shuttle His-CM18-PTD4, as described for FIG. 39. FIGS. 40E and 40F show cells 24 hours post-transduction, while panels G and H show cells 48 hours post-transduction. FIGS. 40E and 40G show mCherry™ fluorescence, and FIGS. 40F and 40H show GFP fluorescence, the latter resulting from removal of the STOP codon by the transduced CRISPR/Cas9-NLS complex and subsequent non-homologous repair by the cell. No significant cellular GFP fluorescence was observed in negative control samples (i.e., cells exposed to CRISPR/Cas9-NLS complex without any shuttle agent; data not shown).

13.4 T7E1 Assay

The T7 endonuclease I (T7E1) can be used to detect on-target CRISPR/Cas genome editing events in cultured cells. As an overview, genomic DNA from target cells is amplified by PCR. The PCR products are then denatured and reannealed to allow heteroduplex formation between wild-type DNA and CRISPR/Cas-mutated DNA. T7E1, which recognizes and cleaves mismatched DNA, is used to digest the heteroduplexes. The resulting cleaved and full-length PCR products are visualized by gel electrophoresis.

The T7E1 assay was performed with the Edit-R™ Synthetic crRNA Positive Controls (Dharmacon #U-007000-05) and the T7 Endonuclease I (NEB, Cat #M0302S). After the delivery of the CRISPR/Cas complex, cells were lysed in 100 µL of Phusion™ High-Fidelity DNA polymerase (NEB #M0530S) laboratory with additives. The cells were incubated for 15-30 minutes at 56° C., followed by deactivation for 5 minutes at 96° C. The plate was briefly centrifuged to collect the liquid at bottom of the wells. 50-µL PCR samples were set up for each sample to be analyzed. The PCR samples were heated to 95° C. for 10 minutes and then slowly (>15 minutes) cooled to room temperature. PCR product (-5 µL) was then separated on an agarose gel (2%) to confirm amplification. 15 µL of each reaction was incubated with T7E1 nuclease for 25 minutes at 37° C. Immediately, the entire reaction volume was run with the appropriate gel loading buffer on an agarose gel (2%).

13.5 his-CM18-PTD4 and his-C(LLKK)₃C-PTD4-Mediated CRISPR/Cas9-NLS System Delivery and Cleavage of Genomic PPIB Sequence A mix composed of a Cas9-NLS recombinant protein (25 nM; Example 13.1) and crRNA/tracrRNA (50 nM; see below) targeting a nucleotide sequence of the PPIB gene were co-incubated with 10 µM of His-CM18-PTD4 or His-C(LLKK)₃C-PTD4, and incubated with HeLa cells for 16 h in medium without serum using Protocol A as described in

Example 9.1

The sequences of the crRNA and tracrRNAs constructed and their targets were:

```
- Feldan tracrRNA [SEQ ID NO: 77]:
5'- AAACAGCAUAGCAAGUUAAAAUAAGGCUAGUCCGUUAUCAACUUG

AAAAAGUGGCACCGAGUCGGUGCU-3'

- PPIB crRNA [SEQ ID NO: 78]:
5'-GUGUAUUUUGACCUACGAAUGUUUUAGAGCUAUGCUGUUUUG-3'

- Dharmacon tracrRNA [SEQ ID NO: 79]:
5'-AACAGCAUAGCAAGUUAAAAUAAGGCUAGUCCGUUAUCAACUUGAA

AAAGUGGCACCGAGUCGGUGCUUUUUUU-3'
```

After 16 h, HeLa cells were washed with PBS and incubated in medium with serum for 48 h. HeLa cells were harvested to proceed with the T7E1 protocol assay as described in Example 13.4.

FIG. 41A shows an agarose gel with the PPIB DNA sequences after PCR amplification. Lane A shows the amplified PPIB DNA sequence in HeLa cells without any treatment (i.e., no shuttle or Cas9/RNAs complex). Lanes B: The two bands framed in white box #1 are the cleavage product of the PPIB DNA sequence by the CRIPR/Cas9 complex after the delivery of the complex with the shuttle His-C(LLKK)₃C-PTD4. Lane C: These bands show the amplified PPIB DNA sequence after incubation of the HeLa cells with the Cas9/RNAs complex without shuttle (negative control). Lane D: The bands framed in white box #2 show the amplified PPIB DNA sequence after incubation of the HeLa cells with the Cas9/RNAs complex in presence of a lipidic transfection agent (DharmaFect™ transfection reagent #T-20XX-01) (positive control). Similar results were obtained using the shuttle His-CM18-PTD4 (data not shown).

Figure 41B:
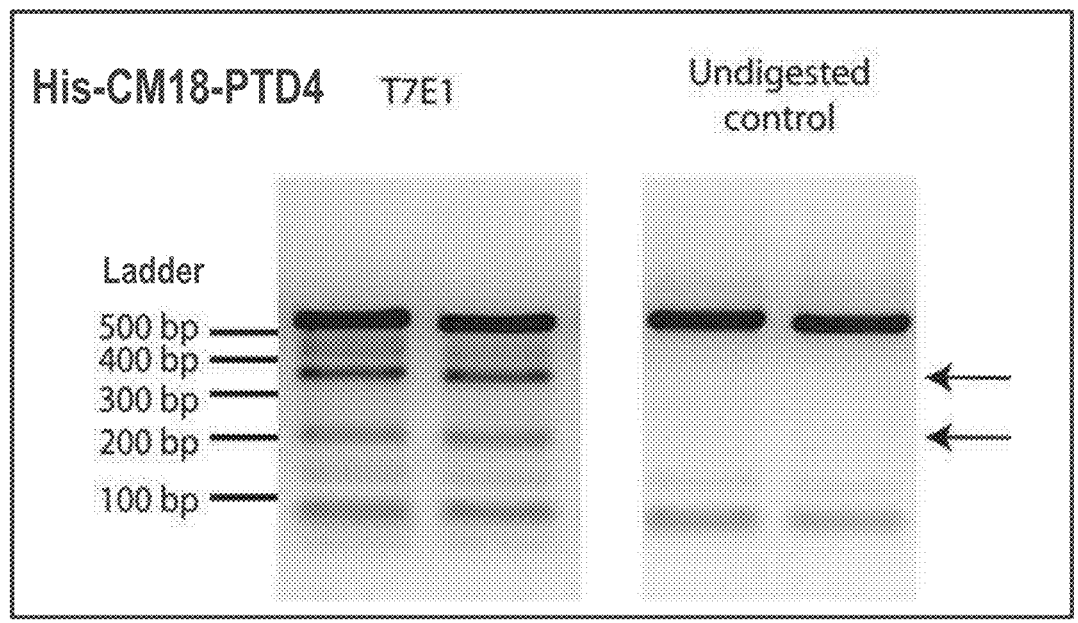
FIG. 41B shows the products of a DNA cleavage assay (T7E1 assay) separated by agarose gel electrophoresis, which is used to measure CRISPR/Cas9-mediated cleavage of cellular genomic DNA (PPIB DNA sequences). The left panel shows the cleavage product of the amplified PPIB DNA sequence by the CRIPR/Cas9 complex after the delivery of the complex with the shuttle agent His-CM18-PTD4 in HeLa cells. The right panel shows amplified DNA sequence before the T7E1 digestion procedure as a negative control.

FIG. 41B shows an agarose gel with the PPIB DNA sequences after PCR amplification. The left panel shows the cleavage product of the amplified PPIB DNA sequence by the CRIPR/Cas9 complex after the delivery of the complex with the shuttle agent His-CM18-PTD4 in HeLa cells. The right panel shows amplified DNA sequence before the T7E1 digestion procedure as a negative control.

Figure 41C:
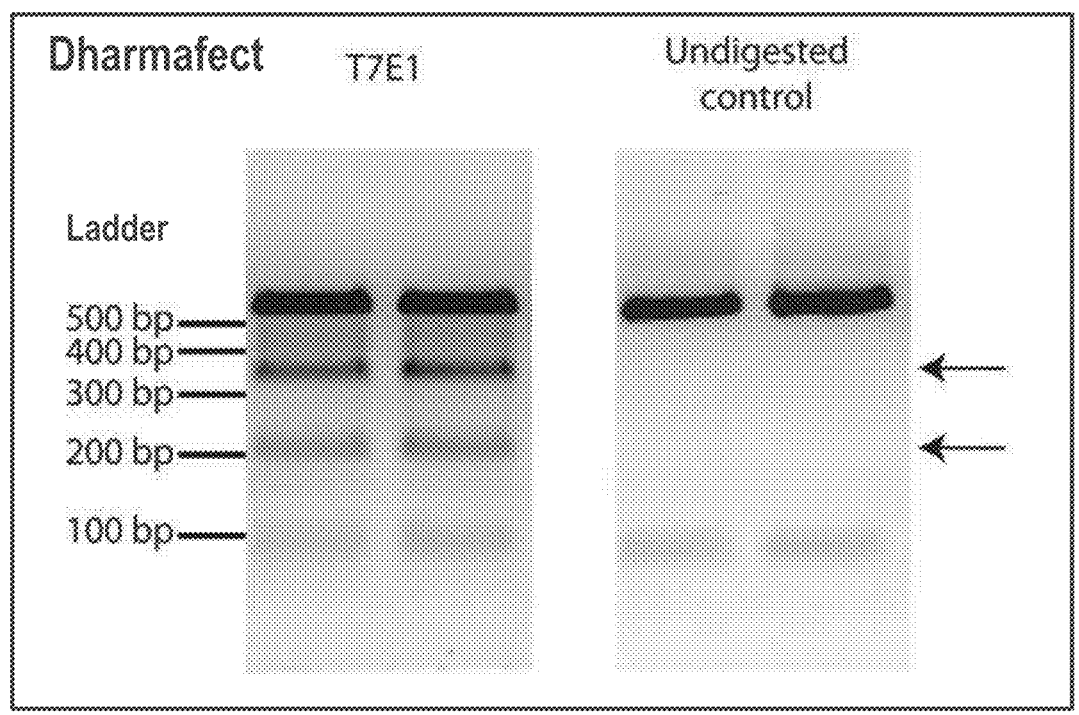
FIG. 41C shows the products of a DNA cleavage assay (T7E1 assay) separated by agarose gel electrophoresis, which is used to measure CRISPR/Cas9-mediated cleavage of cellular genomic DNA (PPIB DNA sequences). The left panel shows the amplified PPIB DNA sequence after incubation of the HeLa cells with the Cas9/RNAs complex in presence of a lipidic transfection agent (DharmaFect™ transfection reagent #T-20XX-01) (positive control). The right panel shows amplified DNA sequence before the T7E1 digestion procedure as a negative control.

FIG. 41C shows an agarose gel with the PPIB DNA sequences after PCR amplification. The left panel shows the amplified PPIB DNA sequence after incubation of the HeLa cells with the Cas9/RNAs complex in presence of a lipidic transfection agent (DharmaFect™ transfection reagent #T-20XX-01) (positive control). The right panel shows amplified DNA sequence before the T7E1 digestion procedure as a negative control.

These results show that the shuttle agents His-CM18-PTD4 and His-C(LLKK)₃C-PTD4 successfully deliver a functional CRISPR/Cas9 complex to the nucleus of HeLa cells, and that this delivery results in CRISPR/Cas9-mediated cleavage of genomic DNA.

13.6 CRISPR/Cas9-NLS System Delivery by Different Shuttle Agents, and Cleavage of Genomic HPTR Sequence in HeLa and Jurkat Cells A mix composed of a Cas9-NLS recombinant protein (2.5 µM; Example 13.1) and crRNA/tracrRNA (2 µM; see below) targeting a nucleotide sequence of the HPTR gene were co-incubated with 35 µM of His-CM18-PTD4, His-CM18-PTD4-His, His-C(LLKK)3C-PTD4, or EB1-PTD4, and incubated with HeLa or Jurkat cells for 2 minutes in PBS using Protocol B as described in Example 9.1.

The sequences of the crRNA and tracrRNAs constructed and their targets were:

```
- Feldan tracrRNA [SEQ ID NO: 77]:
5'-AAACAGCAUAGCAAGUUAAAAUAAGGCUAGUCCGUUAUCAACUUG

AAAAAGUGGCACCGAGUCGGUGCU-3'

- HPRT crRNA [SEQ ID NO: 103]:
5'- AAUUAUGGGGAUUACUAGGAGUUUUAGAGCUAUGCU-3'
```

Figure 46A:
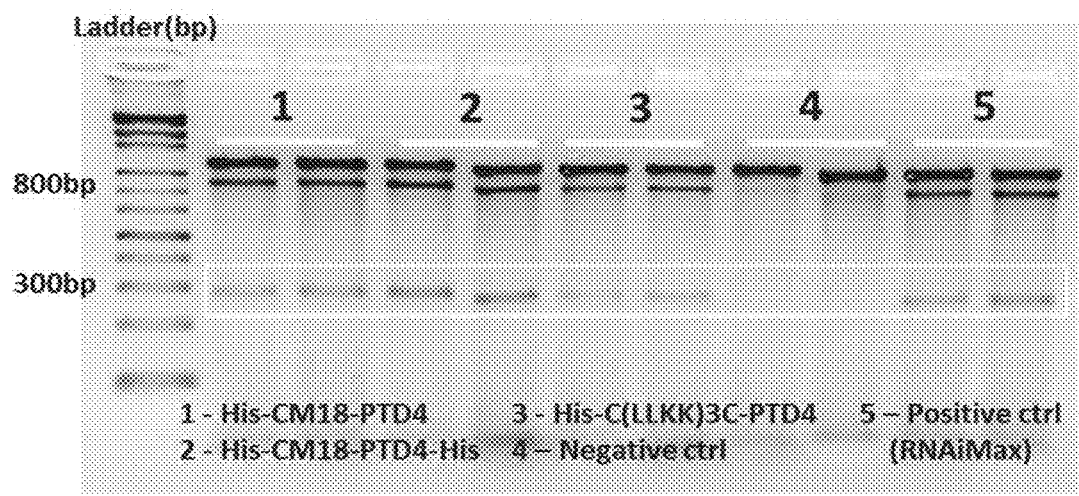
FIGS. 46A and 46B show the products of a DNA cleavage assay separated by agarose gel electrophoresis, which is used to measure CRISPR/Cas9-mediated cleavage of cellular genomic DNA (HPTR sequence) after intracellular delivery of the complex with different shuttle agents.
Figure 46B:
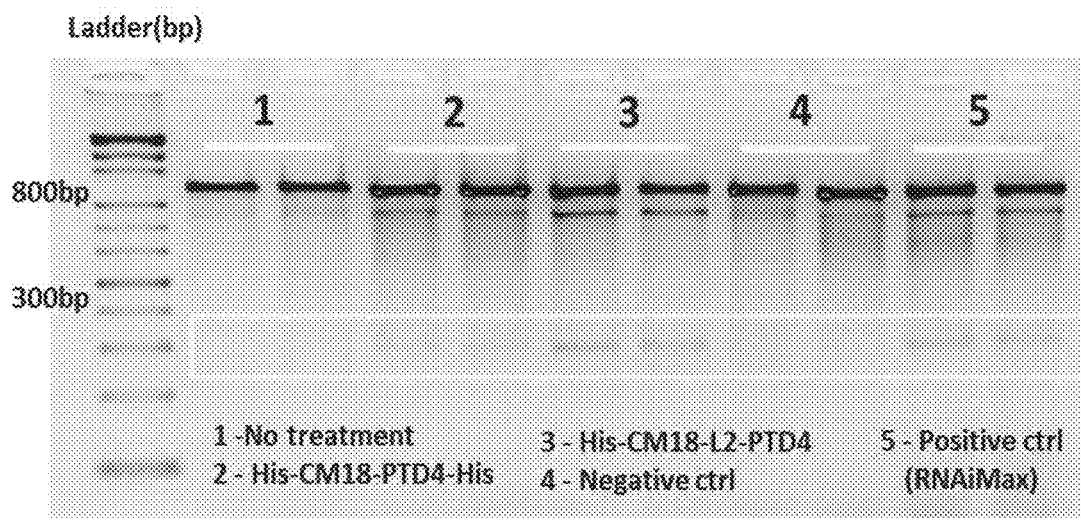

After 2 minutes, cells were washed with PBS and incubated in medium with serum for 48 h. Cells were harvested to proceed with the T7E1 protocol assay as described in Example 13.4. FIG. 46 shows an agarose gel with the HPTR DNA sequences after PCR amplification and the cleavage product of the amplified HPTR DNA sequence by the CRISPR/Cas9 complex after the delivery of the complex with the different shuttle agents. FIG. 46A shows the results with the shuttle agents: His-CM18-PTD4, His-CM18-PTD4-His, and His-C(LLKK)3C-PTD4 in HeLa cells. FIG. 46B shows the results with His-CM18-PTD4 and His-CM18-L2-PTD4 in Jurkat cells. Negative controls (lanes 4) show amplified HPTR DNA sequence after incubation of the cells with the CRISPR/Cas9 complex without the presence of the shuttle agent. Positive controls (lane 5 in FIGS. 46A and 46B) show the amplified HPTR DNA sequence after incubation of the cells with the Cas9/RNAs complex in presence of a lipidic transfection agent (Lipofectamine® RNAiMAX™ Transfection Reagent ThermoFisher Product No. 13778100).

These results show that different polypeptide shuttle agents of the present description may successfully deliver a functional CRISPR/Cas9 complex to the nucleus of HeLa and Jurkat cells, and that this delivery results in CRISPR/Cas9-mediated cleavage of genomic DNA.

Example 14

His-CM18-PTD4 Enables Transduction of the Transcription Factor HOXB4 in THP-1 Cells

14.1 HOXB4-WT Recombinant Protein

Human HOXB4 recombinant protein was constructed, expressed and purified from a bacterial expression system as described in Example 1.4. The sequence of the HOXB4-WT recombinant protein produced was:

```
                                        [SEQ ID NO: 80]
MHHHHHHMAMSSFLINSNYVDPKFPPCEEYSQSDYLPSDHSPGYYAGGQR

RESSFQPEAGFGRRAACTVQRYPPPPPPPPPPGLSPRAPAPPPAGALLPE

PGQRCEAVSSSPPPPPCAQNPLHPSPSHSACKEPVVYPWMRKVHVSTVNP
```

-continued
NYAGGEPKRSRTAYTRQQVLELEKEFHYNRYLTRRRRVEIAHALCLSERQ

IKIWFQNRRMKWKKDHKLPNTKIRSGGAAGSAGGPPGRPNGGPRAL
(MW = 28.54 kDa; pI = 9.89)
The initiator methionine and the 6x Histidine tag are shown in bold.

14.2 Real-Time Polymerase Chain Reaction (rt-PCR)

Control and treated cells are transferred to separate sterile 1.5-mL tubes and centrifuged for 5 minutes at 300g. The cell pellets are resuspended in appropriate buffer to lyse the cells. RNAase-free 70% ethanol is then added followed by mixing by pipetting. The lysates are transferred to an RNeasy™ Mini spin column and centrifuged 30 seconds at 13000 RPM. After several washes with appropriate buffers and centrifugation steps, the eluates are collected in sterile 1.5-mL tubes on ice, and the RNA quantity in each tube is then quantified with a spectrophotometer. For DNase treatment, 2 µg of RNA is diluted in 15 µL of RNase-free water. 1.75 µL of 10X DNase buffer and 0.75 µL of DNase is then added, followed by incubation at 37° C. for 15 minutes. For reverse transcriptase treatment, 0.88 µL of EDTA (50 nM) is added, followed by incubation at 75° C. for 5 minutes. In a PCR tube, 0.5 pg of DNase-treated RNA is mixed with 4 µL of iScript™ Reverse transcription Supermix (5X) and 20 µL of nuclease-free water. The mix is incubated in a PCR machine with the following program: 5 min at 25° C., 30 min at 42° C. and 5 min at 85° C. Newly synthesized cDNA is transferred in sterile 1.5-mL tubes and diluted in 2 µL of nuclease-free water. 18 µL per well of a qPCR machine (CFX-96™) mix is then added in a PCR plate for analysis.

14.3 HOXB4-WT Transduction by his-CM18-PTD4 in THP-1 Cells: Dose Responses and Viability THP-1 cells were cultured and tested in the protein transduction assay using Protocol A as described in Example 9.1. Briefly, THP-1 cells were plated at 30 000 cells/well one day before transduction. HOXB4-WT recombinant protein (0.3, 0.9, or 1.5 M; Example 14.1) was co-incubated with different concentrations of His-CM18-PTD4 (0, 0.5, 7.5, 0.8 or 1 M) and then exposed to THP-1 cells for 2.5 hours in the presence of serum. The cells were subjected to real time-PCR analysis as described in Example 14.2 to measure the mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown in Table 14.1 and FIG. 42.

TABLE 14.1

Figure 42:
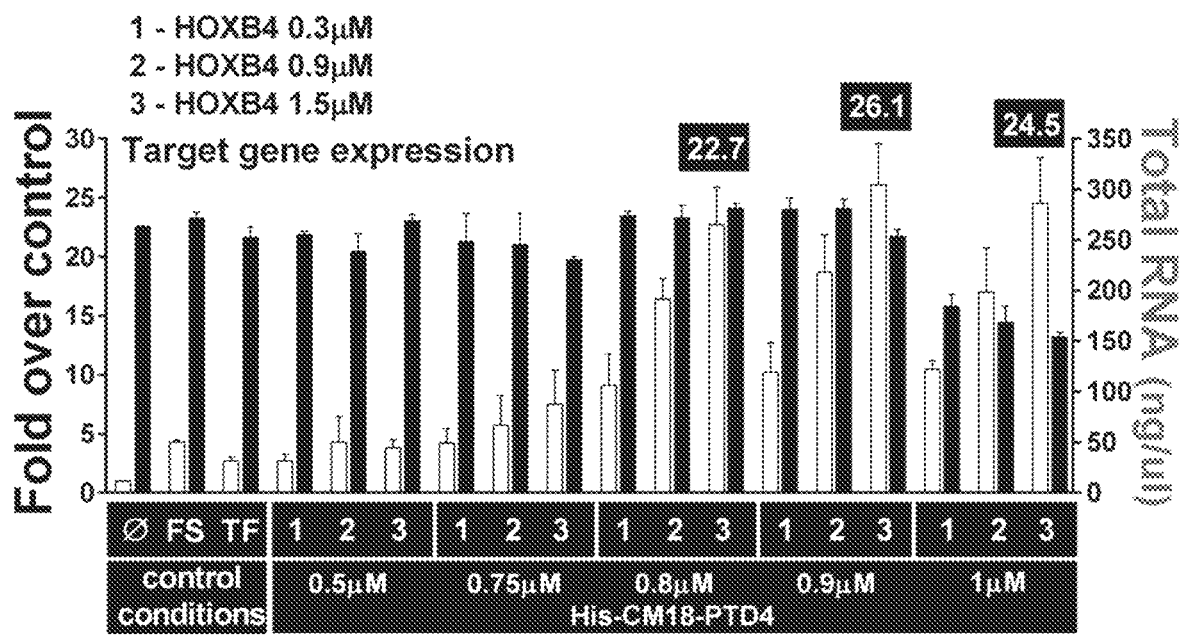

Data from FIG. 42

| Cargo/ shuttle agent (FIG. 41) | Cells | Conc. of shuttle (µM) | Conc. of HOXB4-WT (µM) | Fold over control (mean ± St. Dev) | Total RNA in ng/µL (mean ± St. Dev) |
|---|---|---|---|---|---|
| No treatment ("Ø") | THP-1 | 0 | 0 | 1 ± 0.1 | 263 ± 0.4 |
| HOXB4-WT alone ("TF") | THP-1 | 0 | 1.5 | 4.3 ± 0.1 | 271 ± 6.0 |
| His-CM18-PTD4 alone ("FS") | THP-1 | 1 | 0 | 2.7 ± 0.3 | 252 ± 10.7 |
| His-CM18-PTD4 + HOXB4-WT | THP-1 | 0.5 | 0.3 | 2.7 ± 0.6 | 255 ± 3.9 |
|  |  |  | 0.9 | 4.3 ± 2.1 | 239 ± 17.5 |
|  |  |  | 1.5 | 3.8 ± 0.7 | 269 ± 6.4 |
| His-CM18-PTD4 + HOXB4-WT | THP-1 | 0.75 | 0.3 | 4.2 ± 1.2 | 248 ± 28 |
|  |  |  | 0.9 | 5.7 ± 2.5 | 245 ± 31 |
|  |  |  | 1.5 | 7.5 ± 2.8 | 230 ± 3.3 |
| His-CM18-PTD4 + HOXB4-WT | THP-1 | 0.8 | 0.3 | 9.1 ± 2.7 | 274 ± 4.4 |
|  |  |  | 0.9 | 16.4 ± 1.7 | 272 ± 12.5 |
|  |  |  | 1.5 | 22.7 ± 3.2 | 282 ± 4.7 |
| His-CM18-PTD4 + HOXB4-WT | THP-1 | 0.9 | 0.3 | 10.2 ± 2.5 | 280 ± 11.3 |
|  |  |  | 0.9 | 18.7 ± 3.1 | 281 ± 9.2 |
|  |  |  | 1.5 | 26.1 ± 3.5 | 253 ± 7.1 |
| His-CM18-PTD4 + HOXB4-WT | THP-1 | 1 | 0.3 | 10.5 ± 0.7 | 184 ± 12.3 |
|  |  |  | 0.9 | 17 ± 3.7 | 168 ± 16.2 |
|  |  |  | 1.5 | 24.5 ± 3.9 | 154 ± 4.7 |

These results show that exposing THP-1 cells to a mixture of the shuttle agent His-CM18-PTD4 and the transcription factor HOXB4-WT for 2.5 hours in the presence of serum results in a dose-dependent increase in mRNA transcription of the target gene. These results suggest that HOXB4-WT is successfully delivered in an active form to the nucleus of THP-1 cells, where it can mediate transcriptional activation.

14.4 HOXB4-WT Transduction by his-CM18-PTD4 in THP-1 Cells: Time Course and Viability (0 to 48 Hours)

THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (1.5 µM; Example 14.1) was co-incubated with His-CM18-PTD4 (0.8 µM) and then exposed to THP-1 cells for 0, 2.5, 4, 24 or 48 hours in presence of serum. The cells were subjected to real time-PCR analysis as described in Example 14.2 to measure mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown in Table 14.2 and FIG. 43.

TABLE 14.2

Figure 43:
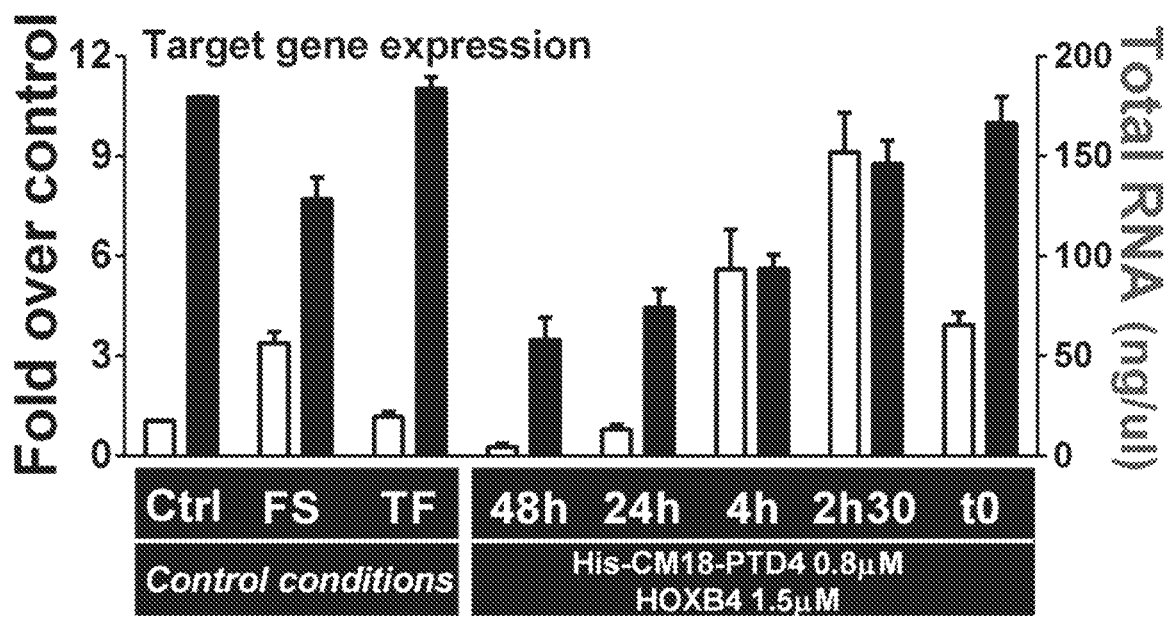

Data from FIG. 43

| Cargo/shuttle agent (FIG. 43) | Cells | Conc. of shuttle (µM) | Conc. of HOXB4-WT (µM) | Exposure time (hours) | Fold over control (mean ± St. Dev) | Total RNA in ng/µL (mean ± St. Dev) |
|---|---|---|---|---|---|---|
| No treatment ("Ctrl") | THP-1 | 0 | 0 | — | 1 ± 0.1 | 180 ± 0.4 |
| HOXB4-WT alone ("TF") | THP-1 | 0 | 1.5 | 2.5 h | 3.4 ± 0.3 | 129 ± 10.7 |
| His-CM18-PTD4 alone ("FS") | THP-1 | 0.8 | 0 | 2.5 h | 1.2 ± 0.14 | 184 ± 6.0 |

TABLE 14.2-continued

Data from FIG. 43

| Cargo/shuttle agent (FIG. 43) | Cells | Conc. of shuttle ($\mu$M) | Conc. of HOXB4-WT ($\mu$M) | Exposure time (hours) | Fold over control (mean ± St. Dev) | Total RNA in ng/$\mu$L (mean ± St. Dev) |
|---|---|---|---|---|---|---|
| His-CM18-PTD4 + HOXBA-WT | THP-1 | 0.8 | 1.5 | 48 h | 0.27 ± 0.1 | 58 ± 11.2 |
|  |  |  |  | 24 h | 0.8 ± 0.14 | 74 ± 9.2 |
|  |  |  |  | 4 h | 5.6 ± 1.2 | 94 ± 7.1 |
|  |  |  |  | 2.5 h | 9.1 ± 1.2 | 146 ± 11.6 |
|  |  |  |  | 0 | 3.9 ± 0.4 | 167 ± 13 |

14.5 HOXB4-WT Transduction by his-CM18-PTD4 in THP-1 Cells: Time Course and Viability (0 to 4 Hours)

THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (0.3 $\mu$M; Example 14.1) was co-incubated with His-CM18-PTD4 (0.8 $\mu$M) and then exposed to THP-1 cells for 0, 0.5, 1, 2, 2.5, 3 or 4 hours in presence of serum. The cells were subjected to real time-PCR analysis as described in Example 14.2 to measure mRNA levels of a target gene as a marker for HOXB4 activity, which was then normalized to target gene mRNA levels detected in the negative control cells (no treatment), to obtain a "Fold over control" value. Total RNA levels (ng/$\mu$L) were also measured as a marker for cell viability. Results are shown in Table 14.3 and FIG. 44.

TABLE 14.3

Data from FIG. 44

| Cargo/shuttle agent (FIG. 42) | Cells | Conc. of shuttle ($\mu$M) | Conc. of HOXB4-WT ($\mu$M) | Exposure time (hours) | Fold over control (mean ± St. Dev) | Total RNA in ng/$\mu$L (mean ± St. Dev) |
|---|---|---|---|---|---|---|
| No treatment ("Ctrl") | THP-1 | 0 | 0 | — | 1 ± 0.1 | 289 ± 9.2 |
| His-CM18-PTD4 alone ("FS") | THP-1 | 0 | 0.3 | 2.5 h | 2.5 ± 0.2 | 260 ± 7.1 |
| HOXB4-WT alone ("TF") | THP-1 | 0.8 | 0 | 2.5 h | 1 ± 0.14 | 264 ± 12.3 |
| His-CM18-PTD4 + HOXBA-WT | THP-1 | 0.8 | 0.3 | 4 h | 1.2 ± 0.1 | 198 ± 6.0 |
|  |  |  |  | 3 h | 1.3 ± 0.21 | 268 ± 12.5 |
|  |  |  |  | 2.5 h | 2 ± 0.3 | 275 ± 4.7 |
|  |  |  |  | 2 h | 2.2 ± 0.2 | 269 ± 12.5 |
|  |  |  |  | 1 | 9.7 ± 2.6 | 268 ± 3.9 |
|  |  |  |  | 0.5 | 23.1 ± 2.0 | 266 ± 17.5 |
|  |  |  |  | 0 | 4 ± 0.5 | 217 ± 6.4 |

14.6 HOXB4-WT Transduction by his-CM18-PTD4 in HeLa Cells: Immuno-Labelling and Visualization by Microscopy Recombinant HOXB4-WT transcription factor (25 $\mu$M; Example 14.1) was co-incubated with 35 $\mu$M of His-CM18-PTD4 and exposed to HeLa cells for 10 seconds using Protocol B as described in Example 9.1. After a 30-minute incubation to allow transduced HOXB4-WT to accumulate in the nucleus, the cells were fixed, permeabilized and immuno-labelled as described in Example 3.2a. HOXB4-WT was labelled using a primary mouse anti-HOXB4 monoclonal antibody (Novus Bio #NBP2-37257) diluted 1/500, and a secondary anti-mouse antibody Alexa™-594 (Abcam #150116) diluted 1/1000. Nuclei were labelled with DAPI. The cells were visualized by bright field and fluorescence microscopy at 20× and 40× magnifications as described in Example 3.2, and sample results are shown in FIG. 45. Co-localization was observed between nuclei labelling (FIGS. 45A and 45C) and HOXB4-WT labelling (FIGS. 45B and 45D), indicating that HOXB4-WT was successfully delivered to the nucleus after 30 min in the presence of the shuttle agent His-CM18-PTD4. White triangle windows show examples of areas of co-localization between the nuclei (DAPI) and HOXB4-WT immuno-labels.

14.7 HOXB4-WT Transduction by Different Shuttle Agents in THP-1 Cells: Dose Responses and Viability THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (1.5 $\mu$M; Example 14.1) co-incubated with the shuttle agents His-CM18-PTD4, TAT-KALA, EB1-PTD4, His-C(LLKK)3C-PTD4 and His-CM18-PTD4-His at 0.8 $\mu$M, and then exposed to THP-1 cells for 2.5 hours in presence of serum. The cells were subjected to real time-PCR analysis as described in Example 14.2 to measure mRNA levels of a target gene as a marker for HOXB4 activity, which was then normalized to target gene mRNA levels detected in the negative control cells (no treatment), to obtain a "Fold over control" value. Total RNA levels (ng/$\mu$L) were also measured as a marker for cell viability. Results are shown in Table 14.4 and FIG. 47.

TABLE 14.4

Figure 47:
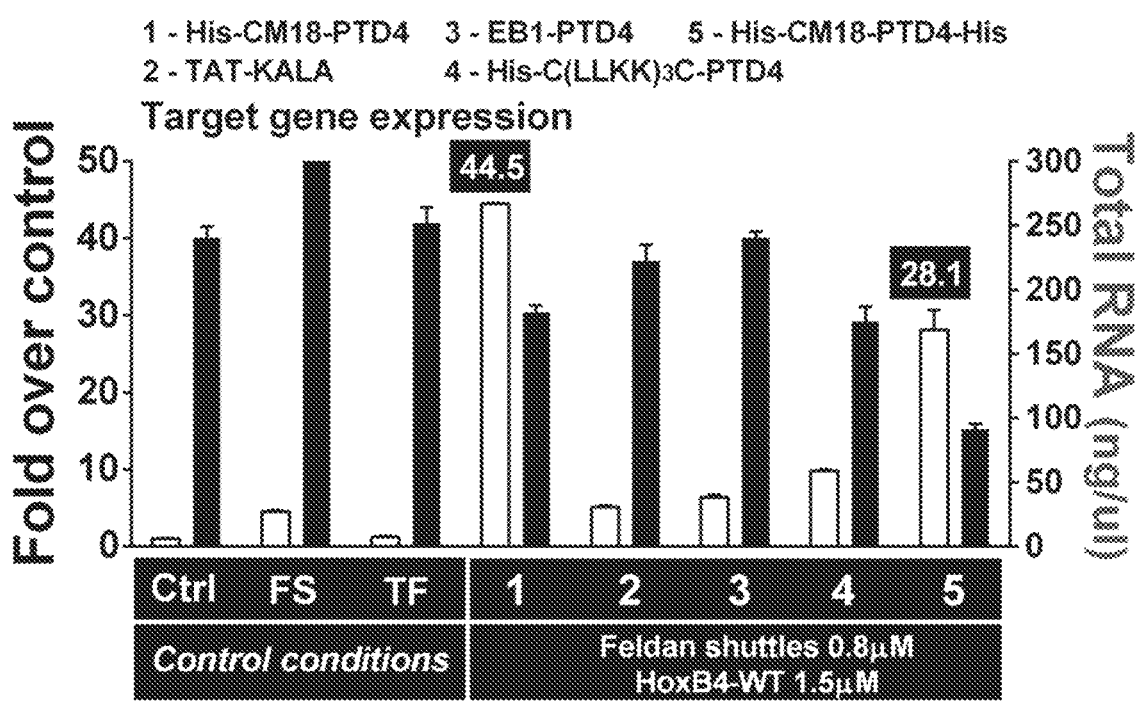
FIG. 47 shows the transcriptional activity of THP-1 cells that have been transduced with the transcription factor HOXB4 using the shuttle agents His-CM18-PTD4, TAT-KALA, EB1-PTD4, His-C(LLKK)3C-PTD4 and His-CM18-PTD4-His. Successful intra-nuclear delivery of HOXB4 was determined by monitoring mRNA levels of a target gene by real-time PCR, and the results were normalized against those in the negative control (HOXB4 without shuttle agent) and expressed as "Fold over control" (left bars). Total cellular RNA (ng/µL) was quantified and used a marker for cell viability (right bars). "0" or "Ctrl" means "no treatment"; "TF" means "Transcription Factor alone"; "FS" means "shuttle alone".

Data from FIG. 47

| Cargo/ shuttle agent | Shuttle conc. (μM) | HOXB4-WT Conc. (μM) | Exposure time | Fold over control (mean ± St. Dev) | Total RNA in ng/μL (mean ± St. Dev) |
|---|---|---|---|---|---|
| No treatment ("Ctrl") | 0 | 0 | — | 1 ± 0.09 | 240.3 ± 8.9 |
| His-CM18-PTD4 alone ("FS") | 0 | 1.5 | 2.5 h | 2.5 ± 0.3 | 303.9 ± 7.6 |
| HOXB4-WT alone ("TF") | 0.8 | 0 | 2.5 h | 1 ± 0.11 | 251.9 ± 11.9 |
| His-CM18-PTD4 + HOXB4-WT | 0.8 | 1.5 | 2.5 h | 44.5 ± 0.09 | 182 ± 5.97 |
| TAT-KALA + HOXB4-WT | | | | 5.1 ± 0.21 | 222.4 ± 12.5 |
| EB1-PTD4 + HOXB4-WT | | | | 6.4 ± 0.3 | 240.4 ± 4.71 |
| His-C(LLKK)3C-PTD4 + HOXB4-WT | | | | 9.8 ± 0.19 | 175.3 ± 11.25 |
| His-CM18-PTD4-His + HOXB4-WT | | | | 28.1 ± 2.61 | 91.4 ± 3.92 |

Example 15

In Vivo GFP-NLS Delivery in Rat Parietal Cortex by his-CM18-PTD4

The ability of the shuttle agent His-CM18-PTD4 to deliver GFP-NLS in vivo in the nuclei of rat brain cells was tested.

In separate sterile 1.5-mL tubes, shuttle agent His-CM18-PTD4 was diluted in sterile distilled water at room temperature. GFP-NLS, used as cargo protein, was then added to the shuttle agent and, if necessary, sterile PBS was added to obtain the desired concentrations of shuttle agent and cargo in a sufficient final volume for injection in rat brain (e.g., 5 μL per each injection brain site). The shuttle agent/cargo mixture was then immediately used for experiments. One negative control was included for the experiment, which corresponds to the injection of the GFP-NLS alone.

Bilateral injections were performed in the parietal cortex of three rats. In the left parietal cortex (ipsilateral), a mix composed of the shuttle agent (20 μM) and the GFP-NLS (20 μM) was injected, and in the right parietal cortex (contralateral), only the GFP-NLS (20 μM) was injected as a negative control. For surgical procedures, mice were anesthetized with isoflurane. Then the animal was placed in a stereotaxic frame, and the skull surface was exposed. Two holes were drilled at the appropriate sites to allow bilateral infusion of the shuttle/cargo mix or GFP-NLS alone (20 μM) with 5-μL Hamilton syringe. Antero-posterior (AP), lateral (L), and dorso-ventral (DV) coordinates were taken relative to the bregma: (a) AP+0.48 mm, L±3 mm, V-5 mm; (b) AP-b 2 mm, L±1.3 mm, V-1.5 mm; (c) AP-2.6 mm, L 1.5 mm, V-1.5 mm. The infused volume of the shuttle/cargo mix or cargo alone was 5 μL per injection site and the injection was performed for 10 minutes. After that, experimenter waited 1 min before removing the needle from the brain. All measures were taken before, during, and after surgery to minimize animal pain and discomfort. Animals were sacrificed by perfusion with paraformaldehyde (4%) 2 h after surgery, and brain were collected and prepared for microscopy analysis. Experimental procedures were approved by the Animal Care Committee in line with guidelines from the Canadian Council on Animal Care.

Figure 48A:
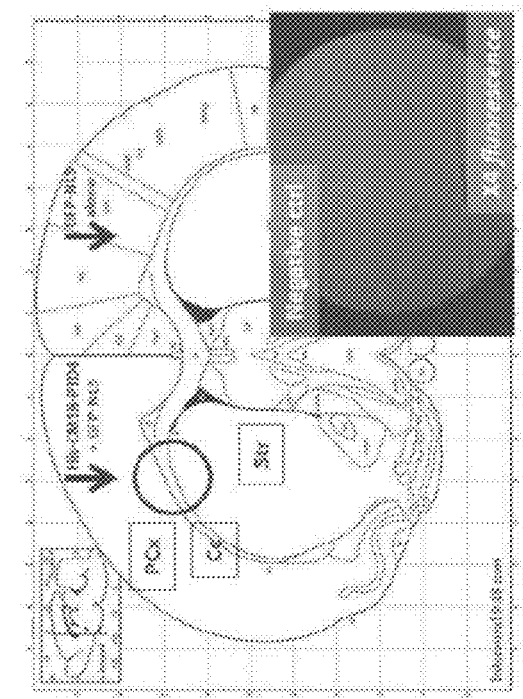
FIGS. 48A-48D show in vivo GFP-NLS delivery in rat parietal cortex by His-CM18-PTD4. Briefly, GFP-NLS (20 µM) was injected in the parietal cortex of rat in presence of the shuttle agent His-CM18-PTD4 (20 µM) for 10 min. Dorso-ventral rat brain slices were collected and analyzed by fluorescence microscopy at 4× (FIG. 48A), 10× (FIG. 48C) and 20× magnifications (FIG. 48D). The injection site is located in the deepest layers of the parietal cortex (PCx). In presence of the His-CM18-PTD4 shuttle agent, the GFP-NLS diffused in cell nuclei of the PCx, of the Corpus Callus (Cc) and of the striatum (Str) (white curves mark limitations between brains structures).
Figure 48B:
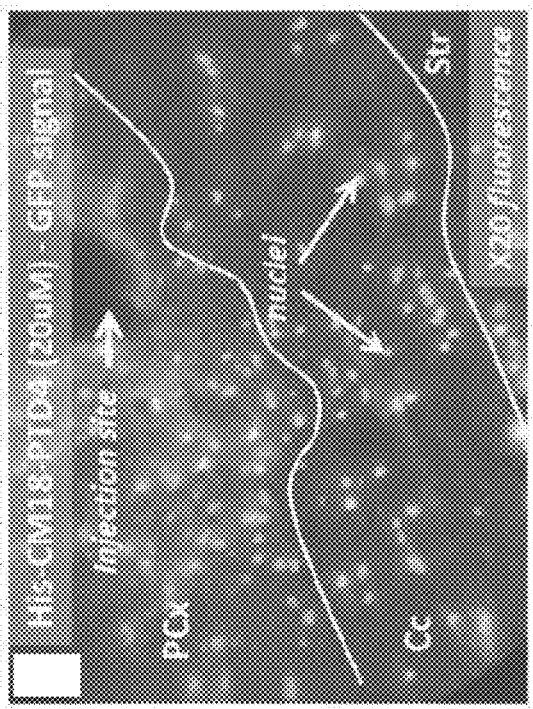
Figure 48C:
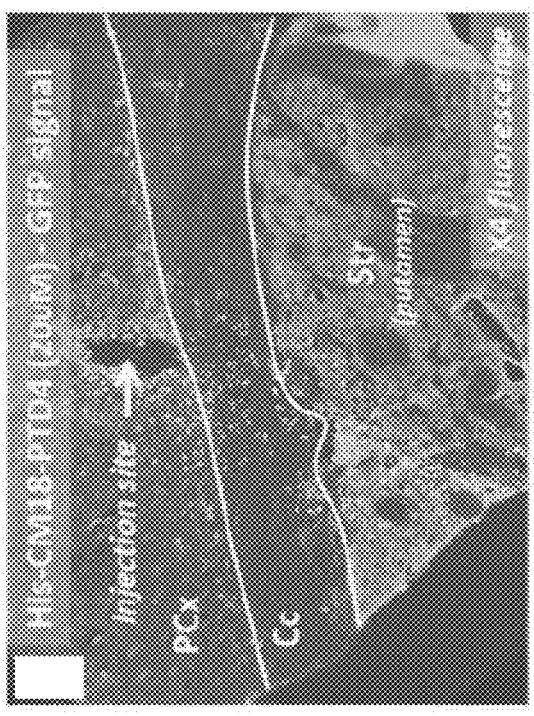
Figure 48D:
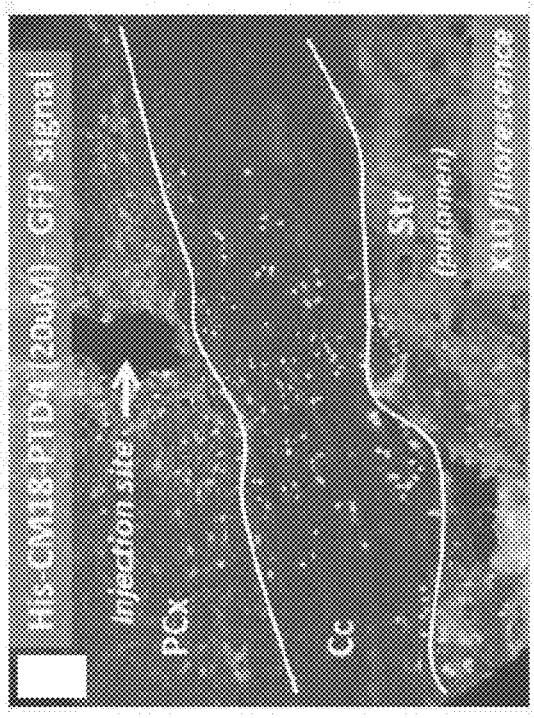

Dorso-ventral rat brain slices were collected and analysed by fluorescence microscopy and results are shown in at 4× (FIG. 48A), 10× (FIG. 48C) and 20× (FIG. 48D) magnifications. The injection site is located in the deepest layers of the parietal cortex (PCx). In the presence of the His-CM18-PTD4 shuttle, the GFP-NLS diffused in cell nuclei of the PCx, of the Corpus Callus (Cc) and of the striatum (Str) (White curves mean limitations between brains structures). FIG. 48B shows the stereotaxic coordinates of the injection site (black arrows) from the rat brain atlas of Franklin and Paxinos. The injection of GFP-NLS in presence of His-CM18-PTD4 was performed on the left part of the brain, and the negative control (an injection of GFP-NLS alone), was done on the contralateral site. The black circle and connected black lines in FIG. 48B show the areas observed in the fluorescent pictures (FIGS. 48A, 48C and 48D).

This experiment demonstrated the cell delivery of the cargo GFP-NLS after its stereotaxic injection in the rat parietal cortex in the presence of the shuttle agent His-CM18-PTD4. Results show the delivery of the GFP-NLS in the nucleus of cells from the deeper layers of the parietal cortex (injection site) to the corpus callus and the dorsal level of the striatum (putamen). In contrast, the negative control in which GFP-NLS is only detectable locally around the injection site. This experiment shows that shuttle agent induced nuclear delivery of the cargo in the injection site (parietal cortex) and its diffusion through both neighboring brain areas (corpus callus and striatum rat brain).

Example A

Physiochemical Properties of Domain-Based Peptide Shuttle Agents

A plurality of different peptides was initially screened with the goal of identifying polypeptide-based shuttle agents that can deliver independent polypeptide cargos intracellularly to the cytosol/nucleus of eukaryotic cells. On one hand, these large-scale screening efforts led to the discovery that domain-based peptide shuttle agents (see Examples 1-15), comprising an endosome leakage domain (ELD) operably linked to a cell penetrating domain (CPD), and optionally one or more histidine-rich domains, can increase the transduction efficiency of an independent polypeptide cargo in eukaryotic cells, such that the cargo gains access to the cytosol/nuclear compartment. Conversely, these screening efforts revealed some peptides having no or low polypeptide cargo transduction power, excessive toxicity, and/or other undesirable properties (e.g., poor solubility and/or stability).

Based on these empirical data, the physiochemical properties of successful, less successful, and failed peptides were compared in order to better understand properties common to the more successful shuttle agents. This approach involved manually stratifying the different peptides according to transduction performance with due consideration to, for example: (1) their solubility/stability/ease of synthesis; (2) their ability to facilitate endosomal escape of calcein (e.g., see Example 2); (3) their ability to deliver one or more types of independent polypeptide cargo intracellularly, as evaluated by flow cytometry (e.g., see Examples 3-6 and 8-15) in different types of cells and cell lines (e.g., primary, immortalized, adherent, suspension, etc.) as well as under different transduction protocols; and (4) their ability to deliver polypeptide cargos to the cytosol and/or nucleus, as evaluated by fluorescence microscopy (e.g., for fluorescently labelled cargos), increased transcriptional activity (e.g., for transcription factor cargos), or genome editing capabilities (e.g., for nuclease cargos such as CRISPR/Cas9 or CRISPR/Cpf1) (e.g., see Examples 3-6 and 8-15), and toxicity towards different types of cells and cell lines (e.g., primary, immortalized, adherent, suspension, etc.), under different transduction protocols.

In parallel to the above-mentioned manual curation, the transduction power and cellular toxicity of each peptide for a given fluorescently-labelled cargo (GFP, GFP-NLS, or fluorescently-labelled antibodies) and cell line were combined into a single "transduction score" as a further screening tool, which was calculated as follows: [(Highest percentage transduction efficiency observed by flow cytometry for a given peptide in a cell type) x (Percentage viability for the peptide in the tested cell line)]/1000, giving an overall transduction score between 0 and 10 for a given cell type and polypeptide cargo. These analyses identified domain-based peptides having transduction scores ranging from about 8 (e.g., for successful domain-based peptide shuttle agents) to as low as 0.067 (e.g., for single-domain negative control peptides).

The above-mentioned manual curation and "transduction score"-based analyses revealed a number of parameters that are common to many successful domain-based shuttle agents. Some of these parameters are listed in the Table A1. An example of a "transduction score"-based analyses in HeLa cells using GFP as a polypeptide cargo is shown in Table A2. Other transduction score-based analyses using cell lines other than HeLa and polypeptides cargos other than GFP, were also performed but are not shown here for brevity.

No successful shuttle agents were found having less than 20 amino acid residues in length (see parameter 1 in Tables A1 and A2). The four amino acids alanine, leucine, lysine and arginine, were the principal and most recurrent residues in most of the successful shuttle agents (35-85% of residues of the peptide; see parameter 10). These residues dictate the alpha-helical structure and amphiphilic nature of these peptide sequences (parameters 2-5). There was often a balance between the percentages of A/L residues (15-45%) and K/R residues (20-45%) in the shuttle agents (parameters 11,12 and 14), and the percentages of negatively charged residues was often found to be not greater than 10% (parameter 14). Conversely, the sixteen other amino acid residues (other than A, L, K, and R) represented generally between 10-45% of the shuttle agents (parameter 15). Successful shuttle agents generally had a predicted isoelectric point (µI) of between 8-13 (parameter 7), and a predicted net charge greater than or equal to +4 (parameter 6), with dCM18-TAT-Cys having a predicted net charge of as high as +26. Hydrophobic residues (A, C, G, I, L, M, F, P, W, Y, V) composed generally between 35-65% of the shuttle agents, and neutral hydrophilic residues (N, Q, S, T) represented generally from 0-30% (parameters 8 and 9).

As shown in Table A2, the most successful shuttle agents (e.g., transduction scores above 5.0) generally had few parameters outside the ranges set forth in Table A1. However, significant increases in transduction efficiency were also observed for shuttle agents in which several parameters were not satisfied, depending for example on the extent to which the unsatisfied parameters fall outside the recommended range, and/or on whether other parameters fall closer to the middle of a recommended range. Thus, shuttle agents having several parameters which fall within "optimal" ranges may compensate for other parameters falling outside of the recommended ranges. As mentioned above, peptides shorter than 20 amino acids did not show any significant transduction ability (e.g. transduction scores less than 0.4), regardless of how many other parameters were satisfied. Among the peptides greater than 20 amino acids in length and having transduction scores lower than 0.4, VSVG-PTD4 (score of 0.35) failed to satisfy six parameters, while JST-PTD4 (score of 0.083) failed to satisfy ten parameters. KALA (score of 0.12) failed to satisfy four parameters, with parameters 11 and 14 far exceeding the recommended ranges, reflecting an overabundance of A/L residues and a large imbalance between the percentages of A/L and L/R residues. It is to be understood that the transduction score ranges appearing the Table A2 are arbitrarily selected, and that other ranges can be selected and are within the scope of the present description.

TABLE A1

General physicochemical properties of successful domain-based peptide shuttle agents

| | Parameter | Description | Result |
|---|---|---|---|
| 1 | Minimum length | The minimum length of peptide shuttle agent. | 20 amino acids |
| 2 | Amphipathic alpha-helix | Peptide shuttle agent comprises a predicted amphipathic alpha-helix conformation, (Based on 3D modeling using PEP-FOLD, an online resource for de novo peptide structure prediction: http://bioserv.rpbs.univ-paris-diderot.fr/services/PEP-FOLD/). | Yes |
| 3 | Positively-charged surface | Predicted amphipathic alpha-helix conformation comprises a positively-charged hydrophilic face rich in R and/or K residues, (Based on observation of at least 3 K/R residues clustered to one side of a helical wheel modeling, using the online helical wheel projection tool available at: http://rzlab.ucr.edu/scripts/wheel/wheel.cgi). | Yes |
| 4 | % Highly hydrophobic core | Predicted amphipathic alpha-helix conformation comprises a highly hydrophobic core composed of spatially adjacent L, I, F, V, W, and/or M residues representing a percentage of the overall peptide sequence (calculated excluding histidine-rich domains). This parameter was calculated by first arranging the amino acids of the peptide in an opened cylindrical representation, then delineating an | 12-50% |

TABLE A1-continued

General physicochemical properties of successful domain-based peptide shuttle agents

| | Parameter | Description | Result |
|---|---|---|---|
| | | area of contiguous highly hydrophobic residues (L, I, F, V, W, M), as shown in FIG. 49A, right panel. The number of highly hydrophobic residues comprised in this delineated highly hydrophobic core was then divided by the total amino acid length of the peptide, excluding N- and/or C-terminal histidine-rich domains. For example, for the peptide shown in FIG. 49A, there are 8 residues in the delineated highly hydrophobic core, and 25 total residues in the peptide (excluding the terminal 12 histidines). Thus, the highly hydrophobic core is 32% (8/25). | |
| 5 | Hydrophobic moment | Calculated hydrophobic moment (μ; calculated while excluding histidine-rich domains), using the online helical wheel projection program available from: http://rzlab.ucr.edu/scripts/wheel/wheel.cgi. | 3.5-11 |
| 6 | Net charge | Predicted net charge at physiological pH (calculated from the side chains of K, R, D, and E residues). | ≥+4 |
| 7 | pI | Predicted isoelectric point (pI). (Calculated with the Prot Param software available at: http://web.expasy.org/protparam/). | 8-13 |
| 8 | % hydrophobic residues | Overall percentage of hydrophobic residues (A, C, G, I, L, M, F, P, W, Y, V) in the peptide shuttle agent. | 35-65% |
| 9 | % neutral hydrophilic residues | Overall percentage of neutral hydrophilic residues (N, Q, S, T) in the peptide shuttle agent. | 0-30% |
| 10 | % A, L, K, R | Overall percentage of residues in the peptide shuttle agent which are A, L, K, or R. | 35-85% |
| 11 | % A or L | Overall percentage of residues in the peptide shuttle agent which are A or L. (Number of A + L residues)/(Total number of residues), with there being at least 5% of L in the peptide. | 15-45% |
| 12 | % Positive residues | Overall percentage of residues in the peptide shuttle agent which are K or R. (Number of K + R residues)/(Total number of residues). | 20-45% |
| 13 | % Negative residues | Overall percentage of residues in the peptide shuttle agent which are D or E. (Number of D + E residues)/(Total number of residues). | 0-10% |
| 14 | Difference between % of A/L and K/R | Overall difference (absolute value) between the percentage of A or L (parameter 11) and the percentage of K or R (parameter 12) in the peptide shuttle agent. (Parameter 11) – (Parameter 12). | ≤10% |
| 15 | % infrequent amino acid residues | Overall percentage of residues which are Q, Y, W, P, I, S, G, V, F, E, D, C, M, N, T or H (i.e., not A, L, K, or R). (Number of Q + Y + W + P + I + S + G + V + F + E + D + C + M + N + T + H residues)/(Total number of residues). | 10-45% |

TABLE A2

Physiochemical properties of domain-based peptides stratified by transduction score (in Hela cells using GFP or GFP-NLS as cargo)

| Peptide name | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| *Transduction scores between 3.1-8.0* | | | | | | | | | | | | | | | |
| TAT-KALA | 42 | Y | Y | 12.1 | 3.6 | 13 | 11.5 | 54.5 | 7.5 | 81 | 43.9 | 36.5 | 4.9 | 7.3 | 11.9 |
| His-CM18-PTD4-His | 41 | Y | Y | 24.1 | 6.7 | 8 | 11.8 | 51.6 | 8.1 | 52 | 22.6 | 23 | 0 | −5.7 | 26.8 |
| His-CM18-PTD4 | 35 | Y | Y | 26 | 6.7 | 8 | 11.8 | 51.6 | 8.1 | 52 | 22.6 | 23 | 0 | −5.7 | 31.4 |
| His-C(LLKK)3C-PTD4 | 31 | Y | Y | 24 | 3.6 | 9 | 11.2 | 45.8 | 2.7 | 43 | 20 | 22.9 | 2.9 | −2.9 | 35.5 |
| CM18-L2-PTD4 | 36 | Y | Y | 22.2 | 6.9 | 8 | 11.8 | 63.9 | 14 | 50 | 27.7 | 22.2 | 0 | 5.5 | 50 |
| CM18-His-PTD4 | 35 | Y | Y | 22.8 | 6.7 | 8 | 11.8 | 51.6 | 8.1 | 52 | 22.6 | 23 | 0 | −5.7 | 31.4 |
| CM18-PTD4-His | 35 | Y | Y | 22.8 | 6.7 | 8 | 11.8 | 51.6 | 8.1 | 52 | 22.6 | 23 | 0 | −5.7 | 31.4 |
| His-CM18-TAT | 35 | Y | Y | 24. | 6 | 13 | 12.3 | 37.4 | 8.6 | 49 | 11.5 | 37.1 | 0 | −25 | 34.4 |
| EB1-PTD4 | 34 | Y | Y | 26.5 | 6.3 | 10 | 12.3 | 52.8 | 14.6 | 59 | 29.4 | 29 | 0 | 0 | 35.3 |
| *Transduction scores between 0.5-3.0* | | | | | | | | | | | | | | | |
| HA-CM18-PTD4 | 36 | Y | Y | 26.6 | 6.7 | 8 | 11.8 | 52.4 | 8.9 | 53 | 30.5 | 22.2 | 0 | 8.3 | 30.6 |
| 6Cys-CM18-PTD4 | 35 | Y | Y | 22.6 | 6.5 | 8 | 9.7 | 68.7 | 8.6 | 52 | 28.6 | 22.9 | 0 | 3.7 | 48.8 |
| CM18-L3-PTD4 | 41 | Y | Y | 19.5 | 3.9 | 8 | 11.8 | 64 | 16.3 | 44 | 24.4 | 19.5 | 0 | 4.9 | 51.3 |
| His-CM18-PTD4-6Cys | 41 | Y | Y | 32 | 6.8 | 8 | 9.7 | 58.4 | 2.4 | 44 | 24.4 | 19.5 | 0 | 4.9 | 41.5 |
| Met-His-CM18-TAT-Cys | 37 | Y | Y | 20 | 6.2 | 13 | 12 | 54 | 8.1 | 49 | 10.8 | 21.6 | 0 | 5.4 | 35.2 |
| CM18-L1-PTD4 | 32 | Y | Y | 25.8 | 6.1 | 8 | 11.8 | 59.1 | 14.9 | 56 | 31.3 | 25 | 0 | −11 | 43.8 |
| Xentry-KALA | 37 | Y | Y | 25 | 5.2 | 6 | 9.9 | 67.3 | 0.7 | 76 | b | 21.6 | 5.4 | 32 | 16.2 |
| CM18-TAT-Cys | 30 | N | N | 10.8 | 6.2 | 13 | 12 | 46.3 | 10 | 57 | 13.3 | 43.3 | 0 | −30 | 43.5 |
| Pep1-KALA | 51 | Y | Y | 26.6 | 9.1 | 8 | 10 | 51.1 | 58.9 | 61 | 35.3 | 25.5 | 9.8 | 9.8 | 27.5 |
| 3HA-CM18-PTD4 | 38 | Y | Y | 15.9 | 6.7 | 8 | 11.8 | 57.9 | 7.9 | 55 | 34.2 | 21.1 | 0 | 13.1 | 29 |
| CM18-PTD4 | 29 | Y | Y | 24.2 | 6.7 | 8 | 11.8 | 60.8 | 10.3 | 62 | 34.4 | 27.5 | 0 | 6.9 | 38 |
| 3His-CM18-PTD4 | 32 | Y | Y | 27.6 | 6.7 | 8 | 11.8 | 56.1 | 9.3 | 56 | 29.4 | 25 | 0 | 0 | 34.5 |
| His-CM18-Transportan | 50 | Y | Y | 25 | 2.6 | 9 | 10.6 | 58 | 14 | 51 | 32 | 18 | 0 | 13 | 38 |
| SynB3-KALA | 40 | Y | Y | 22.8 | 3.7 | 10 | 11. | 57.5 | 5 | 78 | 47.5 | 30 | 5 | 17.5 | 15 |

TABLE A2-continued

Physiochemical properties of domain-based peptides stratified by transduction score
(in Hela cells using GFP or GFP-NLS as cargo)

| Peptide name | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| 12His-CM18-PTD4 | 41 | Y | Y | 15 | 6.7 | 8 | 11.8 | 46.4 | 8.8 | 44 | 24.4 | 21.2 | 0 | 4.9 | 26.9 |
| TAT-CM18 | 30 | Y | Y | 27.6 | 4 | 13 | 12 | 46.6 | 10 | 57 | 13.3 | 43.3 | 0 | −30 | 43.5 |
| 9Arg-KALA | 39 | Y | Y | 23.5 | 4.5 | 14 | 12.1 | 51.4 | 0 | 87 | 46.2 | 41 | 5.1 | 5.2 | 5.1 |
| Transduction scores between 0.07–0.4 ||||||||||||||||
| VSVG-PTD4 | 36 | N | N | 11.1 | 4.1 | 6 | 10.3 | 47.4 | 14 | 33 | 16.7 | 16.6 | 0 | 0.1 | 61.3 |
| Penetratin-cys | 17 | N | N | 23.5 | 5.5 | 7 | 11.8 | 41.3 | 17.7 | 41 | 0 | 41.1 | 0 | −41 | 58.8 |
| CM18 | 18 | N | N | 47 | 4.3 | 5 | 10.6 | 61.3 | 11.1 | 50 | 22.3 | 27.8 | 0 | −5.5 | 50 |
| KALA | 30 | Y | Y | 20 | 4.5 | 5 | 9.9 | 66.6 | 0 | 83 | 60 | 23.3 | 6.7 | 36.7 | 6.7 |
| TAT-cys | 12 | N | N | 0 | 1.9 | 8 | 12 | 24.9 | 8.3 | 57 | 0 | 67 | 0 | −67 | 33.3 |
| PTD4 | 11 | Y | Y | 0 | 2.4 | 3 | 11.7 | 64.6 | 9.1 | 82 | 54.5 | 27.3 | 0 | 27.2 | 18.2 |
| His-PTD4 | 17 | Y | Y | 0 | 2.4 | 3 | 11.7 | 41.2 | 5.9 | 53 | 35.3 | 17.6 | 0 | 17.7 | 11.8 |
| JST-PTD4 | 31 | N | N | 35.6 | 13.8 | 2 | 4.7 | 67.6 | 9.6 | 65 | 54.8 | 9.7 | 16.1 | 45.1 | 19.4 |
| C(LLKK)3C | 14 | Y | Y | 42.9 | 5 | 6 | 10.1 | 57.2 | 0 | 86 | 42.9 | 42.9 | 0 | 0 | 14.3 |

Y = Yes;
N = No;
Regular font = value falls within parameter range set forth in Table A1;
Bolded font = value falls outside parameter range set forth in Table A1. His-LAH4-PTD4 yielded a transduction score of above 5.0, but was excluded from this analysis because the intracellular GFP fluorescence pattern was observed by fluorescence microscopy as being punctate, suggesting that the GFP cargo remained trapped in endosomes. Nevertheless, it is worth noting that His-LAH4-PTD4 had several parameters falling outside the ranges set forth in Table A1 with respect to parameters 2, 3, 11, 12, 14 and 15.

Example B

Rational Design of Synthetic Peptide Shuttle Agents

The parameters set forth in Table A1, and empirical knowledge gained (e.g., from Examples 1-15), were used to manually design the peptides listed in Table B1 in order to evaluate whether the parameters can be used for designing successful peptide shuttle agents.

The peptides listed in Table B1 were tested for their ability to transduce GFP-NLS cargo (see Example 3.4) in HeLa cells, using the protein transduction assay as generally described in Example 3.1a. GFP-NLS recombinant protein (10 µM) was co-incubated with 10 µM of the peptides and then exposed to HeLa cells for 1 min. The cells were subjected to flow cytometry analysis as described in Example 3.3. Results are shown in Tables B2 and B3. A "transduction score"-based analysis was also performed as discussed is Example A, and the results are shown in Table B4. Successful nuclear delivery of the transduced GFP-NLS (generally after only 1 minute of exposure to the peptide) was confirmed by fluorescence microscopy as described in Example 3.2 (data not shown).

Peptides FSD1-FSD5 were initially designed based on the successful domain-based shuttle agent His-CM18-PTD4-His, with peptides FSD1-FSD4 being designed to intentionally unrespect one or more parameters set forth in Table A1, and FSD5 being designed to respect all fifteen parameters. As can be seen from Table B2, peptides FSD1-FSD4 displayed transduction efficiencies ranging from 2.45% to 37.6%. In contrast, the peptide FSD5 displayed high transduction efficiency (70.5%) and low toxicity (cell viability of 86%).

3-dimensional modeling using PEP-FOLD, an online resource for de novo peptide structure prediction, predicted an alpha-helical conformation for FSD5 (see FIG. 49C; http://bioserv.rpbs.univ-paris-diderot.fr/services/PEP-FOLD/). In contrast, the peptide VSVG-PTD4, which showed only 3.5% transduction efficiency (see Table 10.3a), was predicted to adopt a different structure which included a shorter alpha helix, short beta-sheets (white arrows), and random coils (white shapeless lines).

Figure 49B:
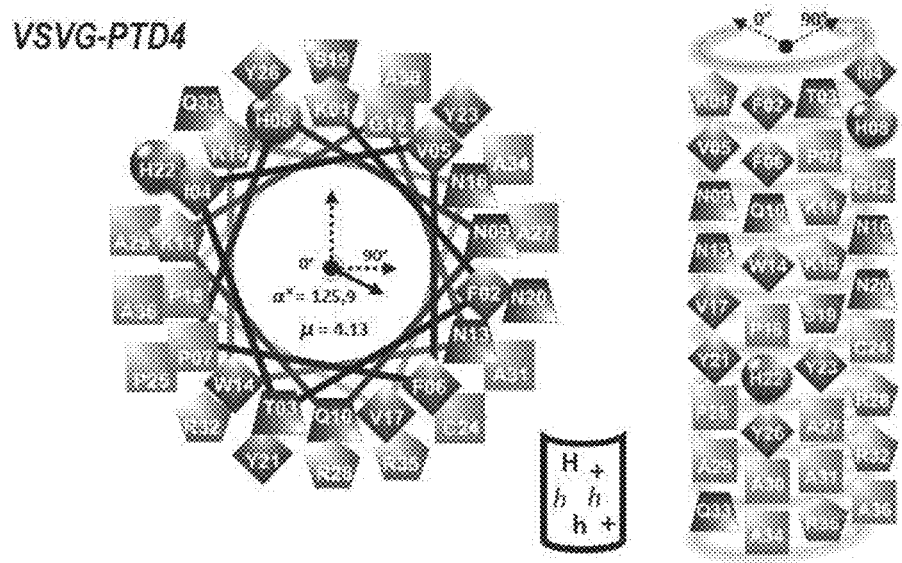

Helical wheel projections and side opened cylindrical representations of FSD5 and VSVG-PTD4 shown in FIGS. 49A and 49B (adapted from: http://rzlab.ucr.edu/scripts/wheel/wheel.cgi) illustrate the amphipathic nature of FSD5, as compared to VSVG-PTD4. The geometrical shape of each amino acid residue corresponds to its biochemical property based on the side chain of the residue (i.e., hydrophobicity, charge, or hydrophilicity). One of the main differences between the two opened cylindrical representations of FSD5 and VSVG-PTD4 is the presence of a highly hydrophobic core in FSD5 (outlined in FIG. 49A, left and right panels), which is not present in VSVG-PTD4. The cylinder in the lower middle panels of FIGS. 49A and 49B represent simplified versions of the opened cylindrical representations in the right panels, in which: "H" represents the high hydrophobic surface area; "h" represents low hydrophobic surface area; "+" represents positively charged residues; and "h" represent hydrophilic residues.

In light of the high transduction efficiency of FSD5, we used this shuttle agent as model to design peptides FSD6-FSD26. As shown in Table B2, a relatively high degree of amino acid substitutions was possible without completely losing transduction power, provided that most of the design parameters set forth in Table A1 were respected. The only peptide that displayed nearly a complete loss transduction efficiency among FSD6-FSD26 was FSD6, which is not predicted to adopt an amphipathic alpha-helix structure. Interestingly, peptide FSD18 showed high toxicity in HeLa cells when used at 10 µM, but showed high transduction efficiency and relatively low toxicity when used in other types of cells (see Examples E and G), suggesting that peptide toxicity may vary depending on the type of cells. 3-dimensional modeling using PEP-FOLD predicted two separate alpha-helices for FSD18 (see FIG. 49D).

Peptides FSN1-FSN8 were designed to explore the effects on transduction efficiency when one or more of the design parameters set forth in Table A1 are not respected.

TABLE B1

Manually-designed synthetic peptides and shuttle agents

| Peptide | SEQ ID NO: | Amino acid sequence | Length (a.a.) | MW (kDa) | pI | Charge |
|---|---|---|---|---|---|---|
| FSD1 | 104 | HHHHHHKWKLLRRAAKKAARRYLKLLLKQLKLHHHHHH | 38 | 4.85 | 12.03 | 11+/0- |
| FSD2 | 105 | HHHHHHWLKLLRRAAKKAARLYRKLLRKARKLHHHHHH | 38 | 4.86 | 12.31 | 12+/0- |
| FSD3 | 106 | HHHHHHKRKKKRRAKKKRAWLYLALLLWALALHHHHHH | 38 | 4.87 | 12.03 | 11+/0- |
| FSD4 | 107 | HHHHHHKRQLKRKLRKWKRLLRLLRLLARLWLHHHHHH | 38 | 5.1 | 12.78 | 12+/0- |
| FSD5 | 108 | HHHHHHLLKLWSRLLKLWTQGRRLKAKRAKAHHHHHH | 37 | 4.68 | 12.49 | 9+/0- |
| FSD6 | 109 | HHHHHHWYLALLALYWQRAKAKTRQRRRHHHHHH | 34 | 4.49 | 11.84 | 7+/0- |
| FSD7 | 110 | HHHHHHWARLARAFARAIKKLYARALRRQARTG | 33 | 3.99 | 12.4 | 9+/0- |
| FSD8 | 111 | HHHHHHKWKLARAFARAIKKLYARALRRQARTG | 33 | 4.02 | 12.31 | 10+/0- |
| FSD9 | 112 | HHHHHHKWKLARAFARAIKKLYARALRRQARTGHHHHHH | 39 | 4.85 | 12.31 | 10+/0- |
| FSD10 | 113 | KWKLARAFARAIKKLGGSGGGSYARALRRQARTG | 34 | 3.66 | 12.31 | 10+/0- |
| FSD11 | 114 | HHHHHHKWKLARAFARALRAIKKLYARALRRQARTG | 36 | 4.36 | 12.4 | 11+/0- |
| FSD12 | 115 | KWKLARAFARAIKKLYARALRRQARTG | 27 | 3.2 | 12.31 | 10+/0- |
| FSD13 | 116 | HHHHHHKWAKLLRAFAKAIKKLYARLARRQARTGHHHHHH | 40 | 4.93 | 12.19 | 10+/0- |
| FSD14 | 117 | HHHHHHLALARWARYFRILAKLKRTKRGQAKAHHHHHH | 38 | 4.73 | 12.19 | 9+/0- |
| FSD15 | 118 | HHHHHHKWKIARAFARSLKKLYARLLARQAKTGHHHHHH | 39 | 4.79 | 12.02 | 9+/0- |
| FSD16 | 119 | HHHHHHLLKLWSRLLKLWTQGRRLKAKRAKA | 31 | 3.86 | 12.49 | 9+/0- |
| FSD17 | 120 | HHHHHHLAKLFKWLRALIRQGAKRKTKRASAHHHHHH | 37 | 4.56 | 12.49 | 9+/0- |
| FSD18 | 121 | LLKLWSRLLKLWTQGGSGGGSGRRLKAKRAKA | 32 | 3.49 | 12.49 | 9+/0- |
| FSD19 | 122 | HHHHHHLLKLWSRLLKTWTQGRRLKAKSAQASTRQAHHHHHH | 36 | 4.32 | 12.48 | 8+/0- |
| FSD20 | 123 | HHHHAAVLKLWKRLLKLFRKGRRLKAKRAKAKR | 33 | 4.12 | 12.71 | 14+/0- |
| FSD21 | 124 | HHHHHHFLKIWSRLIKIWTQGRRKGAQAAFR | 31 | 3.85 | 12.48 | 7+/0- |
| FSD22 | 125 | HHHHHHVLKLWSRILKAFTQGRRMAAKRAKCNHHHHHH | 32 | 3.87 | 12.02 | 8+/0- |
| FSD23 | 126 | HHHHHHLLKLWSRLLKEWTQGRRLEAKRAEAHHHHHH | 31 | 3.88 | 10.93 | 7+/3- |
| FSD24 | 127 | HHHHHHLLCLWSRLLKLWTQGERLKAKCAKACER | 34 | 4.14 | 9.75 | 7+/2- |
| FSD25 | 128 | HHHHHHVWKLFWTLLAAIYGRGKARQKRAKRQARG | 35 | 4.25 | 12.19 | 9+/0- |
| FSD26 | 129 | ALLGLFIKWVKKVGTLFRKAKAGAQNRRAKAQKGK | 35 | 3.88 | 12.33 | 11+/0- |
| FSN1 | 130 | HHHHHHKRKRRSKKRKLWTQGWLLLALLALAHHHHHH | 31 | 3.86 | 12.49 | 9+/0- |
| FSN2 | 131 | HHHHHHKLKLRSRLKWGRTQLWRALAKKALLHHHHHH | 31 | 3.86 | 12.49 | 9+/0- |
| FSN3 | 132 | HHHHHHQFLCFWLNKMGKHNTVWHGRHLKCHKRGKG | 31 | 3.82 | 11.75 | 7+/0- |
| FSN4 | 133 | HHHHHHLLYLWRRLLKFWCAGRRVYAKCAKAYGCF | 35 | 4.23 | 10.06 | 7+/0- |
| FSN5 | 134 | HHHHHHLLKLWRRLLKLFRKALRALAKRAKSALKRAQAA | 39 | 4.68 | 12.71 | 12+/0- |
| FSN6 | 135 | HHHHHHLLKLWSRLLKLWTQALRALAKRAKALAHHHHHH | 33 | 3.96 | 12.31 | 7+/0- |
| FSN7 | 136 | LIKLWSRFIKFWTQGRRIKAKLARAGQSWFG | 31 | 3.75 | 12.48 | 8+/0- |

TABLE B1-continued

Manually-designed synthetic peptides and shuttle agents

| Peptide | SEQ ID NO: | Amino acid sequence | Length (a.a.) | MW (kDa) | pI | Charge |
|---|---|---|---|---|---|---|
| FSN8 | 137 | HHHHHHFRKLWLAIVRAKK | 19 | 2.4 | 12.02 | 5+/0− |
| FSD43 to FSD116 | 169 to 242 | [Refer to Sequence Listing] | — | — | — | — |

Results computed using ProtParam ™ online tool available from ExPASy ™ Bioinformatics Resource Portal (http:/web.expasy.org/protparam/);
pI: Isoelectric point;
Charge: Total number of positively (+) and negatively (−) charged residues

TABLE B2

Transduction of GFP-NLS in HeLa cells

| Cells | Peptide | Mean % cells with GFP signal (±St. Dev.; n = 3) | Cell viability (%) (±St Dev.; n = 3) | Design comments |
|---|---|---|---|---|
| HeLa | No peptide | 0.41 ± 0.015 | 100 | n/a |
| | FSD1 | 37.6 ± 3.44 | 60.3 ± 6.18 | Low % of infrequent amino acids (Q, Y, W, P, I, S, G, V, F, E, D, C, M, N, T, H) |
| | FSD2 | 11.9 ± 1.69 | 76.3 ± 5.99 | High hydrophobic moment |
| | FSD3 | 2.45 ± 0.32 | 91.1 ± 6.37 | No predicted amphipathic alpha helix |
| | FSD4 | 6.60 ± 0.84 | 86.1 ± 8.15 | Low % of hydrophobic amino acids; Low % of infrequent amino acids (Q, Y, W, P, I, S, G, V, F, E, D, C, M, N, T, H) |
| | FSD5 | 70.5 ± 6.44 | 86 ± 7.45 | — |
| | FSD6 | 1 ± 0.12 | 88.1 ± 7.66 | No predicted amphipathic alpha helix |
| | FSD7 | 78.30 ± 5.11 | 38.5 ± 3.48 | — |
| | FSD8 | 62.30 ± 5.61 | 64.8 ± 7.59 | — |
| | FSD9 | 68.21 ± 6.35 | 67.3 ± 5.19 | — |
| | FSD10 | 73.23 ± 4.94 | 79.8 ± 4.73 | — |
| | FSD11 | 68.29 ± 3.11 | 60.9 ± 7.59 | — |
| | FSD12 | 61.58 ± 5.33 | 67.8 ± 4.83 | — |
| | FSD13 | 75.94 ± 7.48 | 49.5 ± 5.13 | High hydrophobic moment |
| | FSD14 | 43.25 ± 5.35 | 92.8 ± 7.42 | — |
| | FSD15 | 54.97 ± 4.28 | 96.1 ± 2.61 | — |
| | FSD16 | 57.34 ± 4.11 | 88.2 ± 2.66 | — |
| | FSD17 | 52.83 ± 6.69 | 99.1 ± 2.09 | — |
| | FSD18 | 77.11 ± 3.25 | 82.4 +/− 4.71 | — |
| | FSD19 | 55.17 ± 4.62 | 80.6 ± 5.36 | — |
| | FSD20 | 75.23 ± 5.91 | 65.4 ± 6.18 | — |
| | FSD21 | 46.74 ± 4.03 | 75.6 ± 5.99 | — |
| | FSD22 | 45.09 ± 3.95 | 80.2 ± 7.21 | — |
| | FSD23 | 50.34 ± 4.29 | 65.3 ± 5.44 | — |
| | FSD24 | 37.48 ± 4.08 | 75.3 ± 3.93 | — |

TABLE B2-continued

Transduction of GFP-NLS in HeLa cells

| Cells | Peptide | Mean % cells with GFP signal (±St. Dev.; n = 3) | Cell viability (%) (±St Dev.; n = 3) | Design comments |
|---|---|---|---|---|
| | FSD25 | 32.67 ± 3.17 | 71.7 ± 5.08 | — |
| | FSD26 | 47.63 ± 4.19 | 59.26 ± 1.27 | — |

"—" = No parameters outside the limits set forth in Table A1.

TABLE B3

Transduction of GFP-NLS in HeLa cells

| Cells | Peptide | Mean % cells with GFP signal (±St Dev.; n = 3) | Cell viability (%) (±St. Dev.; n = 3) | Design comments |
|---|---|---|---|---|
| HeLa | No peptide | 0.38 ± 0.02 | 100 | |
| | FSN1 | 9.14 ± 0.93 | 94.3 ± 3.07 | Low hydrophobic moment; weak amphiphilic structure |
| | FSN2 | 12.13 ± 2.06 | 91.3 ± 4.66 | Weak hydrophobic surface |
| | FSN3 | 1.86 ± 97.15 | 97.2 ± 2.03 | No predicted alpha-helical stricture |
| | FSN4 | 5.84 ± 0.49 | 90.5 ± 4.18 | >65% hydrophobic amino acids |
| | FSN5 | 13.29 ± 1.24 | 85.36 ± 6.16 | Alanine + Leucine > 40% |
| | FSN6 | 15.74 ± 1.63 | 32.63 ± 4.26 | High hydrophobic moment; difference between A/L and K/R residues is > 20% |
| | FSN7 | 3.56 ± 0.36 | 93.45 ± 3.61 | No predicted alpha-helical structure; high hydrophobic moment; 55% of infrequent residues (other than A, L, K, R) |
| | FSN8 | 3.52 ± 0.41 | 94.53 ± 3.72 | Peptide length is less than 20 |

TABLE B4

Physiochemical properties of peptides stratified by transduction score
(in Hela cells using GFP-NLS as cargo)

| Peptide name | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| *Transduction scores above 4.0* | | | | | | | | | | | | | | | |
| FSD5 | 37 | Y | Y | 32 | 8.3 | 9 | 12.5 | 42 | 9.6 | 51 | 27 | 29 | 0 | 2.7 | 16.2 |
| FSD10 | 34 | Y | Y | 14.7 | 7 | 10 | 12.3 | 58.6 | 11.7 | 59 | 29.4 | 29.4 | 0 | 0 | 41.3 |
| FSD15 | 39 | Y | Y | 22.2 | 6.7 | 9 | 12 | 45.3 | 9 | 58 | 30.3 | 27.3 | 0 | 8 | 20.5 |
| FSD17 | 37 | Y | Y | 29.2 | 5.5 | 9 | 12.5 | 41.8 | 9.6 | 58 | 29 | 29 | 0 | 0 | 18.9 |
| FSD16 | 31 | Y | Y | 32 | 8.3 | 9 | 12.5 | 42 | 9.6 | 61 | 27 | 29 | 0 | 2.7 | 19.4 |
| FSD20 | 33 | Y | Y | 27.2 | 7.2 | 14 | 12.7 | 45.4 | 0 | 76 | 33.4 | 42,4 | 0 | −9 | 12 |
| FSD9 | 39 | Y | Y | 18.5 | 6.3 | 10 | 12.3 | 38.6 | 5.2 | 51 | 25.6 | 25.7 | 0 | −0.1 | 17.9 |
| FSD19 | 36 | Y | Y | 19.1 | 8.7 | 8 | 12.5 | 36.2 | 24.9 | 43 | 23.8 | 22.2 | 0 | 4.8 | 28.5 |
| FSD12 | 27 | Y | Y | 18.5 | 6.3 | 10 | 12.3 | 44.4 | 7.4 | 74 | 37 | 37 | 0 | 0 | 25.9 |
| FSD11 | 36 | Y | Y | 17.6 | 7.3 | 11 | 12.4 | 47.3 | 5.6 | 64 | 33.4 | 30.5 | 0 | 2.9 | 19.4 |
| FSD8 | 33 | Y | Y | 18.5 | 6.3 | 10 | 12.3 | 45.3 | 6 | 61 | 33.3 | 30.3 | 0 | 3 | 21.2 |
| FSD14 | 38 | Y | Y | 26.9 | 5.2 | 9 | 12,2 | 46.8 | 6,2 | 59 | 31.3 | 28.1 | 0 | 3.2 | 18.5 |
| *Transduction scores between 1.0-4.0* | | | | | | | | | | | | | | | |
| FSD13 | 40 | Y | Y | 25 | 10.3 | 10 | 12.2 | 35.1 | 8.1 | 46 | 21.6 | 24.3 | 0 | −2.7 | 20 |
| FSD22 | 32 | Y | Y | 20.9 | 7.1 | 8 | 12 | 43.6 | 9.3 | 39 | 18.4 | 25 | 0 | −2.6 | 28.6 |
| FSD21 | 31 | Y | Y | 35.7 | 9.5 | 7 | 12.5 | 45.3 | 12.9 | 39 | 16.2 | 22.6 | 0 | −6.4 | 42.1 |
| FSD23 | 31 | Y | Y | 21.6 | 8.2 | 4 | 10.9 | 38.8 | 9.6 | 43 | 24.3 | 22.6 | 0 | 5.4 | 24.3 |
| FSD7 | 33 | Y | Y | 17.2 | 8.3 | 9 | 12.4 | 48.3 | 5 | 61 | 33.3 | 27.3 | 0 | 10 | 21.2 |
| FSD24 | 34 | Y | Y | 26.5 | 8 | 5 | 9.75 | 47 | 8.7 | 50 | 29.4 | 20.6 | 5.9 | 8.8 | 32.3 |
| FSD26 | 35 | Y | Y | 28.6 | 7 | 11 | 12.3 | 60 | 11.5 | 60 | 28.5 | 31.5 | 0 | −3 | 40.1 |
| FSD25 | 35 | Y | Y | 14.3 | 7.1 | 8 | 12.2 | 48.8 | 8.6 | 63 | 37.1 | 25.7 | 2.9 | 9.7 | 20.1 |
| FSD1 | 38 | Y | Y | 23 | 7.9 | 11 | 12 | 36.8 | 2.6 | 61 | 31.6 | 28.9 | 0 | 2.7 | 7.9 |
| FSD18 | 32 | Y | Y | 25 | 8 | 9 | 12.5 | 59 | 12.6 | 52 | 28.6 | 21.9 | 0 | 5.7 | 43.8 |
| FSN5 | 39 | Y | Y | 28.3 | 12.3 | 12 | 12.7 | 48.8 | 5.2 | 74 | 43.6 | 30.8 | 0 | 12.8 | 10.4 |
| FSN2 | 31 | Y | Y | 24.3 | 1.4 | 9 | 12.5 | 35.1 | 9.6 | 51 | 27 | 29 | 0 | 2.7 | 16.2 |
| *Transduction scores between 0.5-1.0* | | | | | | | | | | | | | | | |
| FSD2 | 38 | Y | Y | 15.4 | 10.9 | 12 | 12.3 | 43.7 | 0 | 63 | 31.6 | 28.9 | 0 | 0 | 19 |
| FSN1 | 31 | N | N | 24.3 | 2.4 | 9 | 12.5 | 35.1 | 9.6 | 51 | 27 | 29 | 0 | 2.7 | 16.2 |
| FSD4 | 38 | Y | Y | 30.8 | 8.8 | 12 | 12.8 | 33.2 | 2.6 | 61 | 28.9 | 31.6 | 0 | −2.7 | 7.9 |
| FSN4 | 35 | Y | Y | 28.6 | 9.9 | 7 | 10.1 | 68.7 | 0 | 46 | 25.7 | 20 | 0 | 5.7 | 37.2 |
| FSN6 | 33 | Y | Y | 28.2 | 11.3 | 7 | 12.3 | 51.6 | 9 | 57 | 38.5 | 21.2 | 0 | 20.5 | 12.9 |
| *Transduction scores below 0.5* | | | | | | | | | | | | | | | |
| FSN7 | 31 | Y | Y | 11.1 | 11 | 8 | 12.5 | 58.2 | 16.2 | 45 | 19.4 | 25.8 | 0 | −6.4 | 55 |
| FSN8 | 19 | Y | Y | 38.8 | 4.2 | 5 | 12 | 36.9 | 0 | 47 | 21 | 26.3 | 0 | −5.3 | 26.5 |
| FSD3 | 38 | N | N | 31.7 | 1.9 | 11 | 12 | 39.5 | 0 | 61 | 31.6 | 28.9 | 0 | 2.7 | 7.8 |
| FSN3 | 31 | N | Y | 29.6 | 5.4 | 7 | 11.8 | 35.5 | 19.3 | 28 | 8.3 | 22.6 | 0 | −11.2 | 44.7 |
| FSD6 | 34 | N | N | 25.1 | 3.5 | 7 | 11.8 | 42.8 | 10.7 | 44 | 23.6 | 25 | 0 | 3 | 17.7 |

Y = Yes;
N = No;
Regular font = value falls within parameter range set forth in Table A1;
Bolded font = value falls outside parameter range set forth in Table A1.

The primary amino acid sequences of peptides FSD5, FSD16, FSD18, FSD19, FSD20, FSD22, and FSD23 are related, as shown in the alignment below.

```
FSD23   --LLKLWSRLLKLWTQG------RRLEAKRAKA-----

FSD19   --LLKLWSRLLKEWTQG------RRLEAKRAEA-----

FSD5    --LLKLWSRLLKLWTQG------RRLKAKRAKA-----

FSD18   AAVLKLWKRLLKLFRKG------RRLKAKRAKAKR---

FSD16   --LLKLWSRLLKTWTQG------RRLKAKSAQASTRQA

FSD20   --LLKLWSRLLKLWTQGGSGGGSGRRLKAKRAKA-----

FSD22   --VLKLWSRILKAFTQG------RRMAAKRAKCN----
```

LKLW-R-LK----G    RR--AK-A (SEQ ID NO: 158)    (SEQ ID NO: 159)

Example C

Computer-Assisted Design of Synthetic Peptide Shuttle Agents

C.1 Machine-Learning-Assisted Design Approach

The peptides listed in Table C1 were designed using an algorithm described in an article by Sebastien Gigubre et al. entitled "Machine Learning Assisted Design of Highly Active Peptides for Drug Discovery" (Gigubre et al., 2014). This computational prediction method is founded on the use of algorithms based on the Kernel and machine learning methods (Shawe-Taylor J. and Cristianini N., 2004). These algorithms aim to sort peptides with maximal bioactivity depending on a biological effect of interest. Here, we considered all the peptides that we tested to date in protein transduction assays, and separated them into three distinct groups. The composition of the groups was based on a "transduction score" calculated as described in Example A. Group 1 was composed of peptides demonstrating efficient cell delivery with low toxicity; Group 2 was composed of peptides demonstrating efficient cell delivery but with elevated toxicity; and Group 3 was composed of peptides that did not demonstrate any significant polypeptide cargo transduction ability.

The scores of the peptides in each group were used as starting data points for the generation of further peptide variants. The algorithm was programmed to use the peptide sequences and the scores of the peptides of Group 1 as the positive references for the prediction of peptide variants with efficient transduction ability. The sequences and the scores of Groups 2 and 3 were included as negative controls in the algorithm to delineate the search field. The peptide variants generated by the algorithm were limited to those having a length of 35 amino acids. After running, the prediction method generated sixteen sequences (FSD27 to FSD42). After analyzing the sequences of these sixteen sequences with respect to the design parameters set forth in Table A1, only peptides FSD27, FSD34 and FSD40 satisfied all of the design parameters (see Table C2). The other peptide variants had one or more parameters outside those set forth in Table A1.

TABLE C1

Machine-designed synthetic peptides and shuttle agents tested

| Peptide | SEQ ID NO: | Amino acid sequence | Length (a.a.) | MW (kDa) | pI | Charge |
|---|---|---|---|---|---|---|
| FSD27 | 138 | HHHHHHKWKLFWEAKLAKYARAAARQARAARQARA | 35 | 4.21 | 11.85 | 9+/1- |
| FSD28 | 139 | HHHHHHHMAHLWESNARKFWKKAFAQHAAAHIAEA | 35 | 4.18 | 9.7 | 4+/2- |
| FSD29 | 140 | LHHHSHHLIHIWLLFKLKLKKKKAARRARRARRHH | 35 | 4.43 | 12.71 | 12+/0- |
| FSD30 | 141 | HHHHHHCLLKKWEAKLAKKIGGGGRQARAKALAKA | 35 | 3.88 | 10.74 | 9+/1- |
| FSD31 | 142 | YHHHHHKWKKRWEAKLAKALRAAGRQARAKALAKA | 35 | 4.12 | 11.62 | 11+/1- |
| FSD32 | 143 | IVRHEHCMIHLWYKNLAKYCSTSHARRLARRRAHH | 35 | 4.35 | 10.92 | 8+/1- |
| FSD33 | 144 | HHHHHHHHRQRRRWEARGGFLGGGGYARAARQARA | 35 | 4.12 | 12.22 | 8+/1- |
| FSD34 | 145 | HHHHHHKLIHIWEAKLFKKIRAAARQARARRAAKA | 35 | 4.19 | 12.19 | 10+/1- |
| FSD35 | 146 | HHHHHHKLLKRWEAKLAKALAKALAKHLAKALAKA | 35 | 3.97 | 10.82 | 9+/1- |
| FSD36 | 147 | HHHHHHCLIHIWEAKLAKKCGGGGYARAAARQARA | 35 | 3.89 | 10.06 | 6+/1- |
| FSD37 | 148 | RLHHSHHLIHIWLLFKLKLKKKKRAARRARRHHHL | 35 | 4.47 | 12.71 | 12+/0- |
| FSD38 | 149 | GHHHHHHHLIHIWEAKLAKLAKALARAAARQARAK | 35 | 3.99 | 11.74 | 7+/1- |
| FSD39 | 150 | HHHHHHHHRQRRRWEARGFLGGGGYARAARQARAA | 35 | 4.14 | 12.22 | 8+/1- |
| FSD40 | 151 | YGRKKRYMLRLWYQNLRMYCKKAYAQHRARQHAKL | 35 | 4.53 | 10.81 | 11+/0- |
| FSD41 | 152 | LHHHHHKLIHIWEAKLAKALAKALARRAAARQARA | 35 | 3.99 | 12.02 | 8+/1- |
| FSD42 | 153 | HHHHHHCMKWWEIVLAKYKGGGGRARAASRRARA | 35 | 3.98 | 11.47 | 8+/1- |

Results computed using ProtParam™ online tool available from ExPASy™ Bioinformatics Resource Portal (http:/web.expasy.org/protparam/);
pI: Isoelectric point;
Charge: Total number of positively (+) and negatively (-) charged residues

TABLE C2

FSD27 to FSD42 sequences and properties

| Peptide | Comments concerning out of limit parameter(s) with respect to Table A1 |
|---|---|
| FSD27 | No out of limit parameters. |
| FSD28 | No predicted amphiphilic alpha-helical structure<br>Highly hydrophobic core <12% of the total surface<br>Net charge below +4 (+2)<br>Low percentage K/R residues (11.5%)<br>Difference between % A/L and % K/R greater than 10% (17.1%) |
| FSD29 | No predicted amphiphilic alpha-helical structure<br>Highly hydrophobic core <12% of the total surface<br>Low hydrophobic moment (3.3) |
| FSD30 | Highly hydrophobic core <12% of the total surface<br>Low hydrophobic moment (2.6) |
| FSD31 | Highly hydrophobic Core <12% of the total surface |
| FSD32 | No predicted amphiphilic alpha-helical structure<br>Highly hydrophobic core <12% of the total surface |
| FSD33 | Highly hydrophobic core <12% of the total surface<br>Low hydrophobic moment (2.1)<br>Less than 5% leucines (2.9%)<br>Difference between % A/L and % K/R greater than 10% (22.9%) |
| FSD34 | No out of limit parameters. |
| FSD35 | Highly hydrophobic core <12% of the total surface<br>Low hydrophobic moment (2.8)<br>High % of A/L (48.6%)<br>Difference between % A/L and % K/R greater than 10% (22.8%)<br>Low % of total non-A/L/K/R residues (2.85%) |
| FSD36 | No predicted amphiphilic alpha-helical structure<br>Low hydrophobic moment (3.3)<br>Highly hydrophobic Core <12% of the total surface<br>Difference between % A/L and % K/R greater than 10% (11.4%) |
| FSD37 | No predicted amphiphilic alpha-helical structure |
| FSD38 | Difference between % A/L and % K/R greater than 10% (20%) |
| FSD39 | Highly hydrophobic core <12% of the total surface |
| FSD40 | No out of limit parameters. |
| FSD41 | High % of A/L (46%)<br>Difference between % A/L and % K/R greater than 10% (23%) |
| FSD42 | Less than 5% leucines (2.9%) |

HeLa cells were cultured and tested in the protein transduction assay described in Example 3.1a. GFP-NLS recombinant protein (10 µM) was co-incubated with 10 µM of the peptide and then exposed to HeLa cells for 1 min. The cells were subjected to flow cytometry analysis as described in Example 3.3. Results are shown in Table C3.

TABLE C3

Transduction of GFP-NLS in HeLa cells by machine-designed synthetic peptides

| Cells | Peptide | Mean % cells with GFP signal (±St. Dev.; n = 3) | Cell viability (%) (±St. Dev.; n = 3) |
|---|---|---|---|
| HeLa | No peptide | 0.22 ± 0.03 | 100 |
| | FSD27* | 25.49 ± 6.52 | 96.6 ± 4.94 |
| | FSD28 | 0.83 ± 0.29 | 99.4 ± 4.04 |
| | FSD29 | 6.43 ± 2.6 | 89.8 ± 8.48 |
| | FSD30 | 1.75 ± 1.14 | 99.1 ± 0.52 |
| | FSD31 | 6.90 ± 1.27 | 97.8 ± 4.22 |
| | FSD32 | 3.12 ± 1.03 | 99.2 ± 3.37 |
| | FSD33 | 0.68 ± 0.45 | 98.1 ± 1.73 |
| | FSD34* | 32.89 ± 8.9 | 97.9 ± 8.18 |
| | FSD35 | 2.08 ± 0.92 | 81.7 ± 3.45 |
| | FSD36 | 0.35 ± 0.2 | 98.9 ± 0.38 |
| | FSD37* | 11.57 ± 2.99 | 73.9 ± 2.62 |
| | FSD38 | 4.61 ± 1.33 | 98.1 ± 7.35 |
| | FSD39 | 0.23 ± 0.09 | 97.3 ± 2.07 |
| | FSD40* | 32.66 ± 0.77 | 83.9 ± 4.16 |
| | FSD41* | 36.99 ± 0.88 | 79.5 ± 0.33 |
| | FSD42 | 1.59 ± 0.39 | 97.3 ± 1.07 |

*Peptides demonstrating transduction efficiencies above 10% appear in bold.

Interestingly, the three peptides generated using the algorithm that respected all of the design parameters set forth in Table A1 (i.e., FSD27, FSD34 and FSD40) each demonstrated 25-33% transduction efficiency, with cell viabilities ranging from 83.9%-98%. The other peptides generally demonstrated transduction efficiencies below 12%, except for FSD41, which demonstrated a transduction efficiency of 37% (albeit with higher toxicity than FSD27, FSD34, and FSD40). Although only a single parameter (i.e., efficiency score) was used to program the algorithm, the results with FSD27, FSD34 and FSD40 validate the usefulness of the design parameters set forth in Table A1.

C.2 Computer-Assisted Generation of Peptide Variants

A computer-assisted design approach was employed to demonstrate the feasibility of designing and generating peptide variants that respect most or all of the design parameters set forth in Table A1. First, this approach involved manually considering and comparing the primary amino acid sequences of structurally different yet successful peptide shuttle agents to identify general consensus sequences that lead to structural parameters (2), (3) and (4) being respected (i.e., amphipathic alpha-helix formation, a positively-charged face, and a highly hydrophobic core of 12%-50%). Second, the approach involved computer-assisted random peptide sequence generation followed by descriptors filtering, implementing the consensus sequences, and one or more of the design parameters (1) and (5)-(15), in order to generate a list of peptide variants that respect nearly all of the design parameters. This is discussed in more detail below.

Figure 49G:
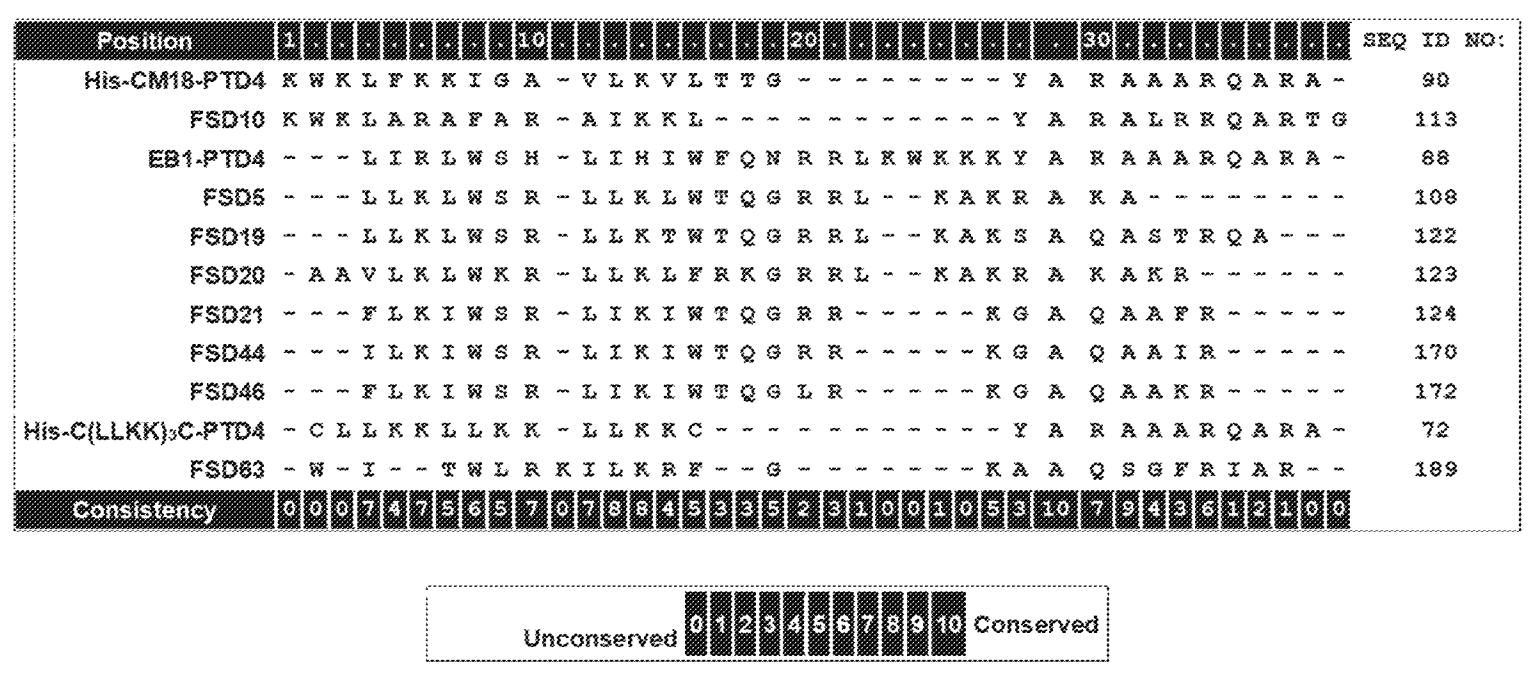

First, the primary amino acid sequences of peptides shown herein to have relatively high transduction efficiency scores were compared using online multiple sequence alignment tools, including CLUSTALW 2.1 (http://www.genome.jp/tools-bin/clustalw); MUltiple Sequence Comparison by Log-Expectation (MUSCLE) (https://www.ebi.ac.uk/Tools/msa/muscle/); and PRALINE (http://www.ibi.vu.nl/programs/pralinewww/). The peptides selected for comparison included the following eleven peptides: His-CM18-PTD4; EB1-PTD4; His-C(LLKK)$_3$C-PTD4; FSD5; FSD10; FSD19; FSD20; FSD21; FSD44; FSD46; and FSD63, but the analyses were not limited to only these eleven peptides. FIG. 49G shows an alignment of the eleven exemplary peptides using PRALINE, wherein the "Consistency" scores at the bottom of each aligned residue position represents the degree of conservation at that residue position (zero being the least conserved, and ten being the most conserved). For example, the alanine (A) at relative position 29 was conserved in all eleven peptides shown in FIG. 49G, and this was assigned a "Consistency" score of 10. Such multiple sequence analyses of the library of described peptides herein (and others) revealed the following general structures:

(a)[X1]–[X2]–[linker]–[X3]–[X4]         (Formula 1);

(b)[X1]–[X2]–[linker]–[X4]–[X3]         (Formula 2);

(c)[X2]–[X1]–[linker]–[X3]–[X4] (Formula 3);
(d)[X2]–[X1]–[linker]–[X4]–[X3] (Formula 4);
(e)[X3]–[X4]–[linker]–[X1]–[X2] (Formula 5);
(f)[X3]–[X4]–[linker]–[X2]–[X1] (Formula 6);
(g)[X4]–[X3]–[linker]–[X1]–[X2] (Formula 7); or
(h)[X4]–[X3]–[linker]–[X2]–[X1] (Formula 8), where [X1], [X2], [X3], [X4], and [linker] are as defined in the table below:

TABLE C4

| | |
|---|---|
| [X1] | <u>2[φ]-1[+]-2[φ]-1[ζ]-1[+]-</u> |
| | or 2[φ]-1[+]-2[φ]-2[+]- |
| | or 1[+]-1[φ]-1[+]-2[φ]-1[ζ]-1[+]- |
| | or 1[+]-1[φ]-1[+]-2[φ]-2[+]- |
| [X2] | <u>-2[φ]-1[+]-2[φ]-2[ζ]-</u> |
| | or -2[φ]-1[+]-2[φ]-2[+]- |
| | or -2[φ]-1[+]-2[φ]-1[+]-1[ζ]- |
| | or -2[φ]-1[+]-2[φ]-1[ζ]-1[+]- |
| | or -2[φ]-2[+]-1[φ]-2[+]- |
| | or -2[φ]-2[+]-1[φ]-2[ζ]- |
| | or -2[φ]-2[+]-1[φ]-1[+]-1[ζ]- |
| | or -2[φ]-2[+]-1[φ]-1[ζ]-1[+]- |
| [linker] | -Gn- |
| | or -Sn- |
| | or -(GnSn)n- |
| | or -(GnSn)nGn- |
| | or -(GnSn)nSn- |
| | or -(GnSn)nGn(GnSn)n- |
| | or -(GnSn)nSn(GnSn)n- |
| [X3] | -4[+]-A- |
| | or -3[+]-G-A- | or -3[+]-A-A- | |
| | or -2[+]-1[φ]-1 [+]-A- | or <u>-2[+]-1[φ]-G-A-</u> | or -2[+]-1[φ]-A-A- |
| | or -2[+]-A-1[+]-A | or -2[+]-A-G-A | or -2[+]-A-A-A- |
| | or -1[φ]-3[+]-A- | or -1[φ]-2[+]-G-A- | or -1[φ]-2[+]-A-A- |
| | or -1[φ]-1[+]-1[φ]-1[+]-A | or -1[φ]-1[+]-1[φ]-G-A | or -1[φ]-1[+]-1[φ]-A-A |
| | or -1[φ]-1[+]-A-1[+]-A | or -1[φ]-1[+]-A-G-A | or -1[φ]-1[+]-A-A-A |
| | or -A-1[+]-A-1[+]-A | or -A-1[+]-A-G-A | or -A-1[+]-A-A-A |
| [X4] | -1[ζ]-2A-1[+]-A | or -1[ζ]-2A-2[+] | or <u>-1[+]-2A-1[+]-A</u> |
| | or -1[ζ]-2A-1[+]-1[ζ]-A-1[+] | or -[ζ]-A-1[ζ]-A-1[+] | |
| | or -2[+]-A-2[+] | or -2[+]-A-1[+]-A | |
| | or -2[+]-A-1[+]-1[ζ]-A-1[+] | or -2[+]-1[ζ]-A-1[+] | |
| | or -1[+]-1[ζ]-A-1[+]-A | or -1[+]-1[ζ]-A-2[+] | |
| | or -1[+]-1[ζ]-A-1[+]-1[ζ]-A-1[+] | or -1[+]-2[ζ]-A-1[+] | |
| | or -1[+]-S[ζ]-2[+] | or -1[+]-2[ζ]-1[+]-A | |
| | or -1[+]-2[ζ]-1[+]-1[ζ]-A-1[+] | or -1[+]-2[ζ]-1[ζ]-A-1[+] | |
| | or -3[ζ]-2[+] | or -3[ζ]-1[+]-A | or -3[ζ]-1[+]-1[ζ]-A-1[+] |
| | or -1[ζ]-2A-1[+]-A | or -1[ζ]-2A-2[+] | or -1[ζ]-2A-1[+]-1[ζ]-A-1[+] |
| | or -2[+]-A-[+]-A | or -2[+]-1[ζ]-1[+]-A | |
| | or -1[+]-1[ζ]-A-1[+]-A | or -1[+]-2A-1[+]-1[ζ]-A-1[+] | |
| | or -1[ζ]-A-1[ζ]-A-1[+] | | |

Wherein:

[φ] = Leu, Phe, Trp, Ile, Met, Tyr, or Val

[+] = Lys or Arg

[ζ] = Gln, Asn, Thr, or Ser

A = Ala

G = Gly

S = Ser n = an integer from 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 1 to 4, or 1 to 3

The number preceding the square brackets indicate the number of contiguous residues (e.g., 3[φ] = [φ]-[φ]-[φ])

Underlined sequences indicate the most commonly occurring consensus sequences, based on the alignment shown in FIG. 49G.

Second, a script was designed and built in the programming language, Python, to randomly generate and filter sequences respecting all parameters (except for predicted isoelectric point (pI, parameter 7), because the source code to calculate this parameter was not available at the time of preparing the present example). Structural parameters 2, 3, 4 (amphipathic alpha-helix, positively-charged surface, and highly hydrophobic core) described in Table A1 were respected by entering the consensus sequences set forth in Formulas 1 to 8 and in Table C4 (appropriate alternance of Hydrophobic, Cationic, hydrophilic, Ala and Gly amino acids in the sequence) into the code, and biochemical parameters (1), (5), (6), and (8)-(15) described in Table A1 were all individually included into the code to generate 10 000 variant peptide sequences. These variant peptide sequences correspond to SEQ ID NOs: 243-10 242.

Example D

Rationally-Designed Peptides Facilitate Escape of Endosomally-Trapped Calcein

Calcein endosomal escape assays were performed as generally described in Example 2 and characterized fluorescence microscopy (data not shown) and by flow cytometry (results for FSD5 are shown below). FSD18 displayed similar results to FSD5 (data not shown).

TABLE D1

Calcein endosome escape assays

| Cells | Peptide | Peptide exposure time (min) | Peptide conc. (μM) | Mean Counts (±St. Dev.; n = 3) | Mean Factor |
|---|---|---|---|---|---|
| HeLa | No peptide | 0 | 0 | 4.94 ± 0.39 | 1.0 |
|  | FSD5 | 1 | 10 | 76.31 ± 5.18 | 15.4 |
|  |  |  | 7.5 | 56.41 ± 5.33 | 11.3 |
|  |  |  | 5 | 16.27 ± 1.27 | 3.0 |
|  |  |  | 2.5 | 12.41 ± 0.92 | 1.5 |

The result from fluorescence microscopy and flow cytometry experiments showed that rationally-designed peptide shuttle agents facilitate the escape of endosomally-trapped calcein in a dose-dependent fashion, similar to the domain-based peptide shuttle agents.

Example E

Rationally-Designed Peptides Increase Transduction Efficiency in Different Cell Types Protein transduction assays in different cell types were conducted as generally described in Example 3.1a (adherent cells) or Example 3.1b (suspension cells), using rationally-designed peptides at the indicated concentrations, 10 μM GFP-NLS as cargo, and at the indicated times, before being characterized by flow cytometry (Example 3.3) and fluorescence microscopy (Example 3.2). The results from the flow cytometry are shown in the tables below. Successful delivery of GFP-NLS to the nucleus of cells was verified by fluorescence microscopy (data not shown).

TABLE E1

GFP-NLS transduction in HeLa cells

| Cells | Peptide | Peptide conc. (μM) | Conc. of GFP-NLS (μM) | Incubation time (min) | Mean % cells with GFP signal (±St. Dev.; n = 3) | Cell viability (%) (±St. Dev.; n = 3) |
|---|---|---|---|---|---|---|
| HeLa | No peptide | 0 | 10 | 2 | 0.38 ± 0.05 | 100 |
|  | FSD5 | 10 |  | 1 | 70.5 ± 6.44 | 76 ± 7.45 |
|  |  | 8 |  | 1 | 68.5 ± 5.27 | 85 ± 6.27 |
|  |  | 5 |  | 2 | 63.1 ± 4.19 | 35.5 ± 4.82 |
|  | FSD9 | 10 |  | 1 | 73.5 ± 5.51 | 79.5 ± 6.33 |
|  |  | 8 |  | 1 | 70.2 ± 6.83 | 82.3 ± 7.16 |
|  |  | 5 |  | 2 | 58.4 ± 4.93 | 45.6 ± 3.64 |
|  | FSD10 | 10 |  | 1 | 73.1 ± 5.24 | 79.75 ± 6.37 |
|  |  | 8 |  | 1 | 55.9 ± 5.22 | 83.42 ± 6.38 |
|  |  | 5 |  | 2 | 45.8 ± 4.16 | 55.61 ± 4.28 |

TABLE E2

GFR-NLS transduction in HCC-78 cells (human non-small cell lung carcinoma)

| Cells | Peptide | Peptide conc. (μM) | Conc. of GFP-NLS (μM) | Incubation time (min) | Mean % cells with GFP signal (±St. Dev.; n = 3) | Cell viability (%) n = 3 |
|---|---|---|---|---|---|---|
| HCC-78 | No peptide | 0 | 10 | 2 | 0.21 ± 0.03 | 100 |
|  | FSD5 | 10 |  | 1 | 41.9 ± 3.61 | 15.9 ± 0.83 |
|  |  | 8 |  | 1 | 69.3 ± 5.27 | 87.7 ± 6.52 |
|  |  | 5 |  | 2 | 34.1 ± 3.57 | 75.3 ± 6.18 |
|  | FSD10 | 10 |  | 1 | 45.0 ± 4.23 | 63.1 ± 5.27 |
|  |  | 8 |  | 1 | 15.7 ± 2.67 | 76.1 ± 6.19 |
|  |  | 5 |  | 2 | 22.8 ± 3.06 | 83.1 ± 5.99 |
|  | FSD12 | 10 |  | 1 | 35.9 ± 3.18 | 46.5 ± 4.18 |
|  |  | 8 |  | 1 | 39.7 ± 4.08 | 66.3 ± 6.03 |
|  |  | 5 |  | 2 | 21.4 ± 2.53 | 75.1 ± 6.31 |

TABLE E3

GFP-NLS transduction in NCI-H196 cells (human small cell lung cancer)

| Cells | Peptide | Peptide conc. (μM) | Conc. of GFP-NLS (μM) | Incubation time (min) | Mean % cells with GFP signal (±St. Dev.; n = 3) | Cell viability (%) n = 3 |
|---|---|---|---|---|---|---|
| NCI-H196 | No peptide | 0 | 10 | 2 | 0.1 ± 0.02 | 100 |
|  | FSD5 | 10 |  | 1 | 16 ± 1.27 | 47.19 ± 3.54 |
|  |  | 8 |  | 1 | 9.1 ± 0.99 | 69.94 ± 6.38 |
|  |  | 5 |  | 2 | 7.3 ± 0.82 | 77.19 ± 6.17 |
|  | FSD10 | 10 |  | 1 | 8.3 ± 0.76 | 85.44 ± 7.66 |
|  |  | 8 |  | 1 | 7.4 ± 0.83 | 80.97 ± 8.02 |
|  |  | 5 |  | 2 | 6.4 ± 0.71 | 83.22 ± 7.51 |

TABLE E3-continued

GFP-NLS transduction in NCI-H196 cells (human small cell lung cancer)

| Cells | Peptide | Peptide conc. (μM) | Conc. of GFP-NLS (μM) | Incubation time (min) | Mean % cells with GFP signal (±St. Dev.; n = 3) | Cell viability (%) n = 3 |
|---|---|---|---|---|---|---|
|  | FSD12 | 10 |  | 1 | 6.3 ± 0.68 | 72.52 ± 6.29 |
|  |  | 8 |  | 1 | 4.5 ± 0.38 | 71.86 ± 6.44 |
|  |  | 5 |  | 2 | 5.1 ± 0.42 | 76.51 ± 6.37 |

TABLE E4

GFP-NLS transduction in THP-1 cells

| Cells | Peptide | Peptide conc. (μM) | Conc. of GFP-NLS (μM) | Incubation time (min) | Mean % cells with GFP signal (±St. Dev.; n = 3) | Cell viability (%) (±St. Dev.; n = 3) |
|---|---|---|---|---|---|---|
| THP-1 | No peptide | 0 | 10 | 1.5 | 0.27 ± 0.01 | 100 |
|  | FSD10 | 1 |  | 1 | 42.6 ± 4.29 | 93.5 ± 5.64 |
|  |  | 1 |  | 1.5 | 59.4 ± 3.61 | 78.4 ± 6.15 |
|  |  | 2 |  | 0.5 | 60.5 ± 5.27 | 96.3 ± 2.16 |
|  |  | 2 |  | 1 | 71.9 ± 5.63 | 85.6 ± 5.22 |
|  | FSD18 | 1 |  | 1 | 43.6 ± 3.55 | 95.3 ± 3.11 |
|  |  | 1 |  | 1.5 | 41.7 ± 2.82 | 86.5 ± 6.27 |
|  |  | 2 |  | 0.5 | 53.4 ± 4.29 | 97.9 ± 1.73 |
|  |  | 2 |  | 1 | 78.3 ± 5.48 | 98.6 ± 0.37 |
|  | FSD19 | 2 |  | 0.5 | 55.4 ± 4.63 | 68.7 ± 4.29 |
|  |  | 5 |  | 0.25 | 61.5 ± 6.07 | 60.5 ± 5.71 |
|  | FSD21 | 2 |  | 0.5 | 47.1 ± 3.83 | 75.6 ± 6.38 |
|  |  | 5 |  | 0.25 | 57.3 ± 4.52 | 62.5 ± 5.16 |
|  | FSD25 | 2 |  | 0.5 | 51.9 ± 6.39 | 79.7 ± 6.52 |
|  |  | 5 |  | 0.25 | 51.5 ± 4.17 | 66.9 ± 5.17 |

TABLE E5

GFP-NLS transduction in various suspension cells

| Peptide | Cells | Peptide conc. (μM) | Conc. of GFP-NLS (μM) | Incubation time (min) | Mean % cells with GFP signal (±St. Dev.; n = 3) | Cell viability (%) (±St. Dev.; n = 3) |
|---|---|---|---|---|---|---|
| No peptide | [All] | 0 | 10 | 90 | 0.36 ± 0.03* | 100* |
| FSD18 | DOHH2 | 1 |  | 90 | 2.4 ± 0.42 | 62.5 ± 6.17 |
|  |  | 2 |  | 30 | 26.8 ± 2.19 | 79.8 ± 6.18 |
|  |  | 10 |  |  | 27.2 ± 2.46 | 25.0 ± 2.66 |
|  | HT2 | 1 |  | 90 | 12.3 ± 0.96 | 88.3 ± 7.91 |
|  |  | 2 |  | 30 | 31.0 ± 2.55 | 80.7 ± 7.10 |
|  |  | 10 |  |  | 82.5 ± 4.07 | 63.9 ± 5.35 |
|  | Jurkat | 1 |  | 90 | 10.1 ± 1.11 | 98.6 ± 0.39 |
|  |  | 2 |  | 30 | 11.0 ± 1.29 | 97.4 ± 1.09 |
|  |  | 10 |  |  | 9.9 ± 1.06 | 96.6 ± 2.46 |
|  | KMS-12BM | 1 |  | 90 | 13.6 ± 2.17 | 97.6 ± 1.05 |
|  |  | 2 |  | 30 | 26.2 ± 3.93 | 95.1 ± 3.56 |
|  |  | 10 |  |  | 21.0 ± 1.76 | 92.7 ± 4.11 |
|  | REC-1 | 1 |  | 90 | 1.80 ± 0.88 | 96.2 ± 2.53 |
|  |  | 2 |  | 30 | 10.9 ± 1.34 | 99.0 ± 0.39 |
|  |  | 10 |  |  | 25.0 ± 1.89 | 25.0 ± 3.17 |
|  | NK | 1 |  | 90 | 2.80 ± 0.33 | 99.1 ± 0.08 |
|  |  | 2 |  | 30 | 6.41 ± 1.12 | 98.3 ± 1.00 |
|  |  | 5 |  | 15 | 65.7 ± 5.27 | 94.9 ± 1.63 |

*Quantification of the negative control ("no peptide") was similar for all cell lines tested. Thus, the data (*) represents an average from the "no peptide" controls for at cell lines tested.

Example F

Rationally-Designed Peptide Shuttle Agents Enable Transduction of Antibodies F.1 Transduction of Fluorescently Labeled Antibodies by FSD5 in HeLa Cells Protein transduction assays were conducted as generally described in Example 3.1, using the peptide FSD5 and an antibody as cargo after 1 min incubation time, before being characterized by fluorescence microscopy (Example 3.2). FIG. 50 shows the results of the cytoplasmic transduction of Goat Anti-Mouse IgG H&L (Alexa Fluor®488) and Goat Anti-Rabbit IgG H&L (Alexa Fluor® 594) antibodies delivered in HeLa cells by the peptide FSD5 (8 µM) for 1 min and visualized by fluorescence microscopy at 20× magnification for the Alexa Fluor 594 Ab (FIG. 50A); and at 10× and 20× magnification for the Alexa Fluor 488 Ab (FIGS. 50B and 50C, respectively). The bright field and fluorescence images of living cells are shown in upper and lower panels, respectively.

The following experiments show that other FSD peptides can also deliver functional antibodies: an anti-NUP98 antibody which labels the nuclear membrane, and two anti-Active Caspase3 antibodies that bind and inactivate the pro-apoptotic Caspase 3 protein. The delivery, microscopy and cell immune-labelling protocols are described in Example 3.

F.2 Transduction of Anti-NUP98 Antibody by FSD19 in HeLa Cells

Figure 50D:
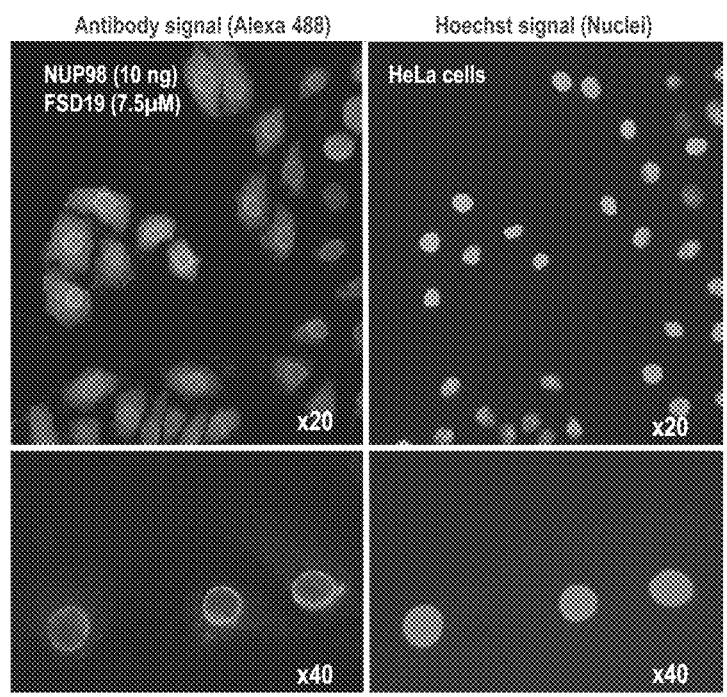
FIG. 50D shows the results of a transduction experiment in which an anti-NUP98 antibody, which recognizes an antigen in the perinuclear membrane, was transduced into HeLa cells using the shuttle agent FSD19. Following transduction, HeLa cells were fixed, permeabilized and labelled with a fluorescent (Alexa™ 488) secondary antibody recognizing the anti-NUP98 antibody (left panels) and Hoechst nuclear staining (right panels). Upper and lower panels indicate images taken under 20× and 40× magnification, respectively.

Anti-NUP98 antibody (10 pg) was co-incubated with 7.5 µM of FSD19 and exposed to HeLa cells for 4 hours. Cells are washed, fixed with paraformaldehyde 4%, permeabilized with 0.1% Triton™ and labeled with a fluorescently labeled (Alexa™ Fluor 488) goat anti-rat antibody. Antibody bound to the perinuclear membrane and cell nuclei were visualized by fluorescence microscopy at 20× (upper panels) and 40× (lower panels). As shown in FIG. 50D, green fluorescent signal emanated from the nuclear membrane (left panels) and overlapped with Hoechst staining (right panels), demonstrating that the anti-NUP98 antibody retained its functionality inside the cell following its transduction.

F.3 Transduction of Two Functional Anti-Active Caspase 3 Antibodies by FSD23 in THP-1 and Jurkat Cells: Quantification by ELISA Cleaved PARP Assay A monoclonal (mAb) and a polyclonal (pAb) anti-Active Caspase 3 antibodies (2 pg) were independently co-incubated with THP-1 and Jurkat cells for 5 min in the presence of FSD23 at 7.5 µM. The anti-apoptotic effect of each antibody was assessed via the level of Caspase 3-activated apoptosis with an ELISA cleaved PARP assay and quantified by spectrometry as described below.

The day of the experiment, cells in exponential growth phase were harvested, centrifuged (400g for 3 min) and resuspended in serum-free RPMI in a 96-well plate (500,000 cells in 150 µL per well). Cells were centrifuged and incubated for 5 min with a mix composed by the peptide to be tested (7.5 µM) and 2 µg of the antibody to be transduced. Cells were centrifuged and resuspended in RPMI with serum in a 24-well plate for 1 h at 37° C. Actinomycin D (2 µg/mL), a cytotoxic inducer of apoptosis, was incubated with the cells for 4 h. Cells were washed with cold PBS and tested using the PARP (Cleaved) [214/215]Human ELISA Kit (ThermoFisher) according to the manufacturer's instructions followed by spectroscopy analysis. Results are shown in Table F1. IDC-1 13,T1

TABLE F1

Cleaved PARP ELISA assay after transduction of anti-TNF or anti-Active Caspase 3 antibody by FSD23 in THP-1 and Jurkat cells

| Cell type | Antibody | Actinomycin D | Optical Density (O.D.) PARP cleavage assay |
|---|---|---|---|
| THP-1 | anti-TNF | − | 0.334 |
|  | (control) | + | 1.162 |
|  | anti-Active | − | 0.207 |
|  | Caspase 3 mAb | + | 0.856 |
|  | anti-Active | − | 0.192 |
|  | Caspase 3 pAb | + | 0.653 |
| Jurkat | anti-TNF | − | 0.281 |
|  | (control) | + | 0.486 |
|  | anti-Active | − | 0.174 |
|  | Caspase 3 mAb | + | 0.301 |
|  | anti-Active | − | 0.149 |
|  | Caspase 3 pAb | + | 0.333 |

Results in THP-1 and in Jurkat cells show that FSD23 successfully transduced functional anti-Active Caspase 3 antibodies. Anti-TNF antibody was used as a non-specific negative control and actinomycin D as a cytotoxic inducer of apoptosis. In the absence of actinomycin D ("−"), the delivery of each anti-Active Caspase 3 mAb and pAb resulted in the reduction of the basal level of apoptosis compared to the "anti-TNF" control, in which the delivery of the anti-TNF antibody had no discernable impact on cell viability. In presence of actinomycin D ("+"), the resulting apoptosis was reduced after the delivery of both anti-Active Caspase 3 antibodies with FSD23 compared to the "anti-TNF" control.

Example G

Rationally-Designed Peptide Shuttle Agents Enable Transduction of CRISPR-Based Genome Editing Complexes We tested the ability of rationally-designed peptide shuttle agents to deliver functional CRISPR-based genome editing complexes to the nucleus of eukaryotic cells using standard DNA cleavage assays. These assays were used to measure CRISPR/Cas9 and CRISPR/Cpf1-mediated cleavage of cellular genomic DNA sequences HPRT (Hypoxanthine Phosphoribosyltransferase 1) and DNMT1 (DNA (Cytosine-5-)-Methyltransferase 1), respectively. Homologous-directed recombination (HDR) of short (72 bp) and long (1631 bp) DNA templates were performed at the HPRT genomic cut site, and measured after intracellular delivery of the genome editing complexes with different shuttle agents.

G.1 CRISPR/Cas9-NLS Complex Transduction by Rationally-Designed Peptide Shuttle Agents, Cleavage of Genomic Target Sequence, and Homologous-Directed Recombination in Different Cell Lines G.1.1 Transduction of Functional CRISPR/Cas9-NLS Complexes Cas9-NLS recombinant protein was prepared as described in Example 13.1. A mix composed of a Cas9-NLS recombinant protein and crRNA/tracrRNA (see below) targeting a nucleotide sequence of the HPTR genes were co-incubated with different concentrations of FSD5, FSD8, FSD10 or FSD18 and incubated with HeLa, HCC-78, NIC-H196 or REC-1 cells for 2 min in PBS, or 48 h in medium with serum, using the transduction protocols as generally described in Example 3.1a. Cells were then washed with PBS and harvested to proceed with the T7E1 protocol assay as described in Example 13.4.

The sequences of the crRNA and tracrRNAs constructed and their targets were:

```
- Feldan tracrRNA [SEQ ID NO: 77]:
5'- AAACAGCAUAGCAAGUUAAAAUAAGGCUAGUCCGUUAUCAACUUG

AAAAAGUGGCACCGAGUCGGUGCU-3'

- HPRT crRNA [SEQ ID NO: 103]:
5'- AAUUAUGGGGAUUACUAGGAGUUUUAGAGCUAUGCU-3'
```

Figure 51A:
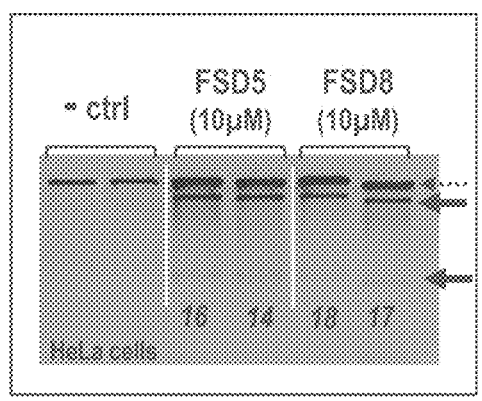
FIGS. 51A-51F show the results of genome editing experiments in which CRISPR/Cas9-NLS genome editing complexes were transduced into different cell types (HeLa (FIG. 51A and FIG. 51B), NK cells (FIG. 51C), NIC-H196 cells (FIG. 51D), HCC-78 cells (FIG. 51E), and REC-1 cells (FIG. 51F) using different shuttle agent peptides (FSD5, FSD8, FSD10, FSD18), and successful genome editing was verified by genomic DNA cleavage assays. The CRISPR/Cas9-NLS complexes consisted of recombinant Cas9-NLS complexed with a crRNA/tracrRNA designed to cleave the HPRT genomic DNA sequence. Successful genome editing was observed by the detection of genomic DNA cleavage products (thick solid arrows), as compared to the uncleaved genomic target gene (thin dashed arrows). The negative control ("ctrl") were from transduction experiments performed in the absence of any shuttle agent peptide. An imaging software was used to quantify the relative signal intensities of the cleavage product bands directly on gels. The sum of all the bands in a given lane corresponds to 100% of the signal, and the numerical value in italics at the bottom of each lane is the sum of the relative signals (%) of only the two cleavage product bands (thick solid arrows).
Figure 51B:
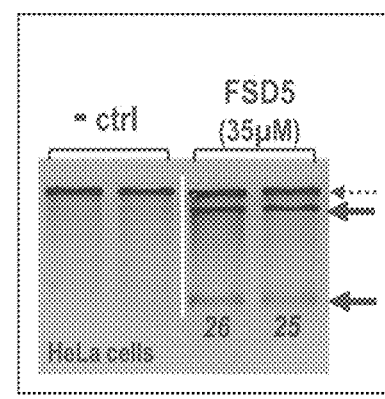
Figure 51C:
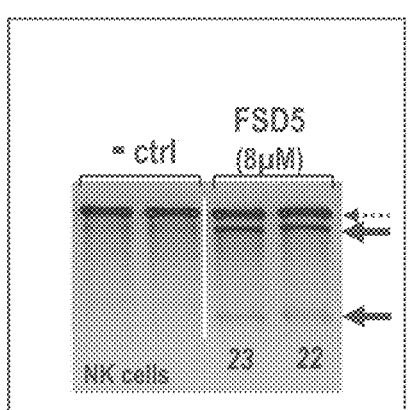
Figure 51D:
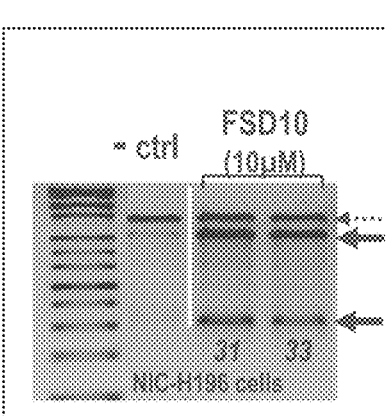
Figure 51E:
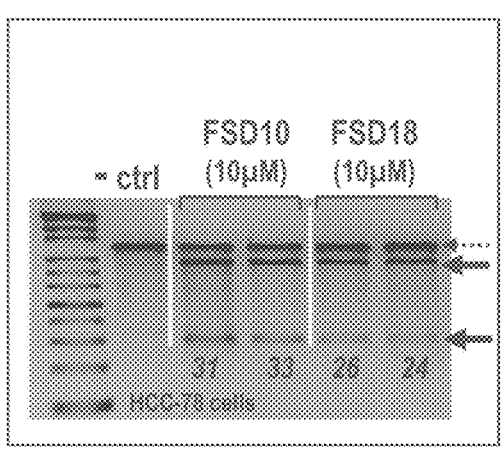
Figure 51F:
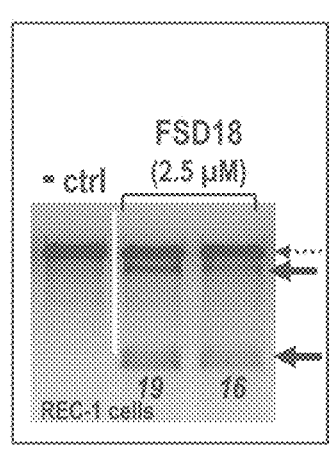

FIGS. 51A-51F show the results of the cleavage of the targeted genomic HPRT DNA sequence with the CRISPR/Cas9 (2.5 µM) and the crRNAltracrRNA (2 µM) in the absence ("-ctrl") or presence of the shuttle agents FSD5, FSD8, FSD10 or FSD18 used at different concentrations, exposure times, and in different types of cells: HeLa (FIGS. 51A and 51B); NK (FIG. 51C); NIC-196H (FIG. 51D); HCC-78 (FIG. 51E) and REC-1 cells (FIG. 51F), after separation by agarose gel electrophoresis. In some cases, gel lanes were loaded in duplicate. Thin dashed arrows indicate the bands corresponding to the target gene, and thicker solid arrows indicate the bands corresponding to the cleavage products of this target gene, which indicate the successful transduction of functional CRISPR/Cas9-NLS genome editing complexes. We used a Bio-Rad ImageLab™ software (Version 5.2.1, Bio-Rad, http://www.bio-rad.com/en-ca/product/image-lab-software?tab=Download) to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thicker solid arrows). No cleave product bands were found in the negative controls ("-ctrl", i.e., to cells that were exposed to CRISPR/Cas9-NLS complex in the absence of shuttle agent). These results indicate the successful delivery of the CRISPR genome-editing complexes to the nucleus, resulting in cleave of the target gene.

G.1.2 Transduction of CRISPR/Cas9-NLS Complexes with Short Linear DNA Template, Resulting in Homologous-Directed Recombination A mix was prepared containing: a Cas9-NLS recombinant protein (2.5 µM) (see Example 13.1); the crRNAltracrRNA (2 µM) targeting a nucleotide sequence of the HPTR genes (see above); the peptide shuttle agent FSD5 (15 µM); and either 0 ng or 500 ng of a short linear template DNA (72 bp; see below).

```
Short DNA template [SEQ ID NO: 154]:
5'-TGAAATGGAGAGCTAAATTATGGGGATTACAAGCTTGATAGCGAAG

GGGCAGCAATGAGTTGACACTACAGA-3'
```

This mixture was exposed to HeLa cells for 48 h in culture media containing serum. Cells were then washed and subjected to the T7E1 assay as described in Example 13.4.

Figure 51G:
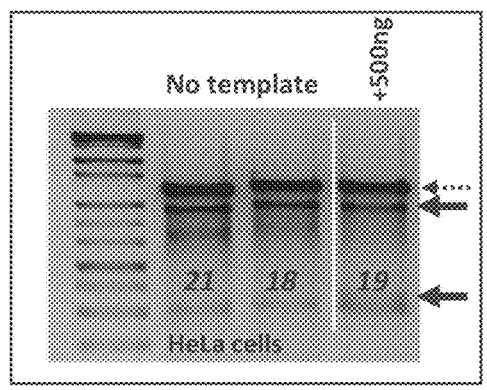
FIG. 51G shows the cleavage of the targeted HPRT genomic sequence by the CRISPR/Cas9-NLS complex transduced by FSD5, in the absence ("No template") or presence ("+500 ng") of a short DNA template (72 bp). Thin dashed arrows indicate the bands corresponding to the target gene, and thick solid arrows indicate the bands corresponding to the CRISPR/Cas9-NLS-mediated cleavage products of this target gene, which indicate the successful transduction of fully functional genome editing complexes in the presence and absence of the DNA template. The numerical value in italics at the bottom of each lane is the sum of the relative signals (%) of only the two cleavage product bands (thick solid arrows).

FIG. 51G shows the cleavage of the targeted HPRT genomic sequence by the CRISPR/Cas9 complex transduced by FSD5 (15 µM), in the absence ("No template") or presence (+500 ng) of the short DNA template. Thin dashed arrows indicate the bands corresponding to the target gene, and thicker solid arrows indicate the bands corresponding to the cleavage products of this target gene, which indicate the successful transduction of fully functional genome editing complexes. The numerical value in italics at the bottom of each lane is the sum of the relative signals (%) of only the two cleavage product bands (thicker solid arrows). These results show that FSD5 can transduce a functional CRISPR/Cas9 complex in the presence or absence of template DNA.

Figure 51H:
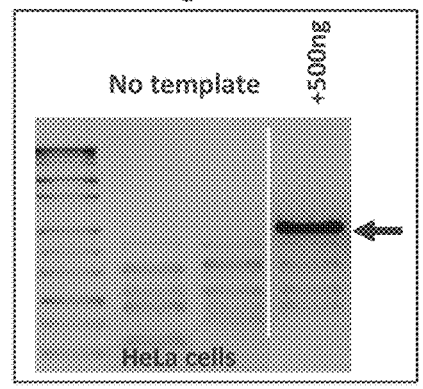
FIG. 51H shows the results of a PCR-amplification of the samples of FIG. 51G, using primers specific for the short DNA template, indicating genomic insertion of the DNA template sequence (see arrow in FIG. 51H).

To verify whether homologous-directed recombination occurred, we used the genomic DNA extracted from FSD5/CRISPR/short DNA template-treated cells to amplify the short DNA template sequence with specifically designed oligonucleotide primers targeting this sequence. The amplification of the short DNA template sequence confirmed the insertion of this template in the genome after the cutting of the HPRT gene by the CRISPR/Cas9-NLS genome editing complex. The PCR products were resolved by agarose gel electrophoresis and the results are shown in FIG. 51H. No amplification was detected in the "no template" sample, in which the genomic DNA was cut but no DNA template was provided (FIG. 51H). In contrast, an amplicon of appropriate size (FIG. 51H, thick solid line) was detected for the "+500 ng" sample, in which the genomic DNA was cut and a DNA template was provided. Detection of the amplicon indicates successful insertion of the short DNA template sequence into the genome. These results show that FSD5 can transduce CRISPR/Cas9 complex in the presence of a short DNA template, resulting in homologous-directed recombination.

G.1.3 Transduction of CRISPR/Cas9-NLS Complexes with Long Linear DNA Template, Resulting in Homologous-Directed Recombination A mix was prepared containing: a Cas9-NLS recombinant protein (2.5 µM) (see Example 13.1); the crRNAltracrRNA (2 µM) targeting a nucleotide sequence of the HPTR genes (see above); the peptide shuttle agent FSD5 (15 µM); and either 0 ng or 500 ng of a long linear template DNA encoding GFP (1631 bp; see below).

```
- GFP coding DNA template [SEQ ID NO: 156]:
5'AAGTAATCAATTACGGGGTCATTAGTTCATAGCCCATATATGGAGTT

CCGCGTTACATAACTTACGGTAAATGGCCCGCCTGGCTGACCGCCCAACG

ACCCCCGCCCATTGACGTCAATAATGACGTATGTTCCCATAGTAACGCCA

ATAGGGACTTTCCATTGACGTCAATGGGTGGAGTATTTACGGTAAACTGC

CCACTTGGCAGTACATCAAGTGTATCATATGCCAAGTACGCCCCCTATTG

ACGTCAATGACGGTAAATGGCCCGCCTGGCATTATGCCCAGTACATGACC

TTATGGGACTTTCCTACTTGGCAGTACATCTACGTATTAGTCATCGCTAT

TACCATGGTGATGCGGTTTTGGCAGTACATCAATGGGCGTGGATAGCGGT

TTGACTCACGGGGATTTCCAAGTCTCCACCCCATTGACGTCAATGGGAGT

TTGTTTTGGCACCAAAATCAACGGGACTTTCCAAAATGTCGTAACAACTC

CGCCCCATTGACGCAAATGGGCGGTAGGCGTGTACGGTGGGAGGTCTATA

TAAGCAGAGCTGGTTTAGTGAACCGTCAGATCCGCTAGCGCTACCGGTCG

CCACCATGGTGAGCAAGGGCGAGGAGCTGTTCACCGGGGTGGTGCCCATC

CTGGTCGAGCTGGACGGCGACGTAAACGGCCACAAGTTCAGCGTGTCCGG

CGAGGGCGAGGGCGATGCCACCTACGGCAAGCTGACCCTGAAGTTCATCT

GCACCACCGGCAAGCTGCCCGTGCCCTGGCCCACCCTCGTGACCACCCTG

ACCTACGGCGTGCAGTGCTTCAGCCGCTACCCCGACCACATGAAGCAGCA

CGACTTCTTCAAGTCCGCCATGCCCGAAGGCTACGTCCAGGAGCGCACCA

TCTTCTTCAAGGACGACGGCAACTACAAGACCCGCGCCGAGGTGAAGTTC
```

-continued

```
GAGGGCGACACCCTGGTGAACCGCATCGAGCTGAAGGGCATCGACTTCAA

GGAGGACGGCAACATCCTGGGGCACAAGCTGGAGTACAACTACAACAGCC

ACAACGTCTATATCATGGCCGACAAGCAGAAGAACGGCATCAAGGTGAAC

TTCAAGATCCGCCACAACATCGAGGACGGCAGCGTGCAGCTCGCCGACCA

CTACCAGCAGAACACCCCCATCGGCGACGGCCCCGTGCTGCTGCCCGACA

ACCACTACCTGAGCACCCAGTCCGCCCTGAGCAAAGACCCCAACGAGAAG

CGCGATCACATGGTCCTGCTGGAGTTCGTGACCGCCGCGGGATCACTCT

CGGCATGGACGAGCTGTACAAGTCCGGACTCAGATCTCGAGCTCAAGCTT

CGAATTCTGCAGTCGACGGTACCGCGGGCCCGGGATCCACCGGATCTAGA

TAACTGATCATAATCAGCCATACCACATTTGTAGAGGTTTTACTTGCTTT

AAAAAACCTCCCACACCTCCCCCTGAACCTGAAACATAAAATGAATGCAA

TTGTTGTTGTTAACTTGTTTATTGCAGCTTATAATGGTTACAAATAAAGC

AATAGCATCACAAATTTCACAAATAAAGCATTTTTTTCACTGCATTCTA

GTTGTGGTTTGTCCAAACTCATCAATGTATCTTAA-3'
```

This mixture was exposed to HeLa cells for 48 h in culture media containing serum. Cells were then washed with PBS and harvested to proceed with the T7E1 protocol assay as described in Example 13.4.

Figure 51I:
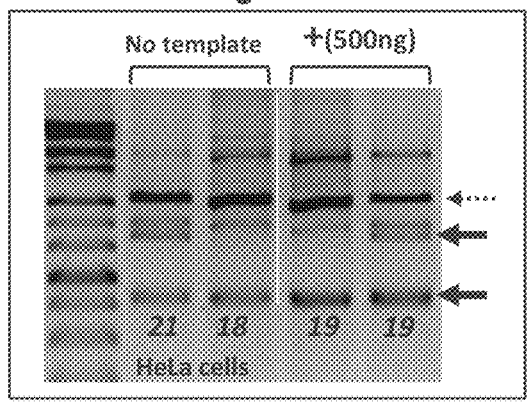
FIG. 51I shows the cleavage of the targeted HPRT genomic sequence by the CRISPR/Cas9-NLS complex transduced by FSD5, in the absence ("No template") or presence ("+500 ng") of a long linear DNA template (1631 bp). Thin dashed arrows indicate the bands corresponding to the target gene, and thick solid arrows indicate the bands corresponding to the CRISPR/Cas9-NLS-mediated cleavage products of this target gene, which indicate the successful transduction of fully functional genome editing complexes in the presence and absence of the DNA template. The numerical value in italics at the bottom of each lane is the sum of the relative signals (%) of only the two cleavage product bands (thick solid arrows).

FIG. 51I shows the cleavage of the targeted genomic HPRT genomic sequence by the CRISPR/Cas9 complex transduced by FSD5 (15 μM), in the absence ("No template") or presence ("+500ng") of the long DNA template. The cleavage products are indicated with thick solid arrows. These results show that FSD5 can transduce a functional CRISPR/Cas9 complex in the presence or absence of a long template DNA.

Figure 51J:
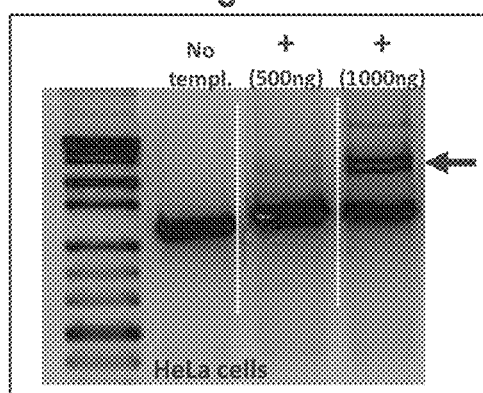
FIG. 51J shows the results of a PCR-amplification of the samples of FIG. 51I, using primers designed to amplify across the genomic cleavage site. Genomic insertion of the long DNA template sequence is visible by the presence of a larger band in the "+500 ng" (faint) and "+1000 ng" (darker) lanes see arrow in FIG. 51J.

To verify whether homologous-directed recombination occurred, we used the genomic DNA extracted from FSD5/CRISPR/long DNA template-treated cells to amplify the long DNA template sequence with specifically designed oligonucleotide primers flanking this sequence. The amplification of the long DNA template sequence confirmed the insertion of this template in the genome after the cutting of the HPRT gene by the CRISPR/Cas9-NLS genome editing complex. The PCR products were resolved by agarose gel electrophoresis and the results are shown in FIG. 51J. In the "No template" sample, a single band corresponding to the amplicon lacking the long DNA template insertion was detected. In contrast, additional larger bands (indicated with an arrow) were detected for the "+500 ng" (faint) and "+1000 ng" (darker) samples, indicating some insertion of the long DNA template into the genomic DNA had occurred. These results show that FSD5 can transduce CRISPR/Cas9 complex in the presence of a long DNA template, resulting in homologous-directed recombination.

G.2 CRISPR/Cpf1-NLS Complex Transduction by Rationally-Designed Shuttle Agents, Cleavage of Genomic Target Sequence in HeLa and NK Cells A mix composed of a Cpf1-NLS recombinant protein (2.5 μM) and crRNA (2 μM; see below) targeting a nucleotide sequence of the DNMT1 gene was co-incubated with different concentrations of FSD18 and incubated with HeLa or NK cells for 2 min in HeLa cells, or 90 sec in NK cells in PBS or in medium without serum using transduction protocols as described in Example 3.1a.

The sequence of the Cpf1-NLS recombinant protein produced was:

```
                                        [SEQ ID NO: 155]
MTQFEGFTNLYQVSKTLRFELIPQGKTLKHIQEQGFIEEDKARNDHYKEL

KPIIDRIYKTYADQCLOLVOLDWENLSAAIDSYRKEKTEETRNALIEEQA

TYRNAIHDYFIGRTDNLTDAINKRHAEIYKGLFKAELFNGKVLKQLGTVT

TTEHENALLRSFDKFTTYFSGFYENRKNVFSAEDISTAIPHRIVQDNFPK

FKENCHIFTRLITAVPSLREHFENVKKAIGIFVSTSIEEVFSFPFYNQLL

TQTQIDLYNQLLGGISREAGTEKIKGLNEVLNLAIQKNDETAHIIASLPH

RFIPLFKQILSDRNTLSFILEEFKSDEEVIQSFCKYKTLLRNENVLETAE

ALFNELNSIDLTHIFISHKKLETISSALCDHWDTLRNALYERRISELTGK

ITKSAKEKVQRSLKHEDINLQEIISAAGKELSEAFKOKTSEILSHAHAAL

DQPLPTTLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKENORVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGEMPAWDIVFEKNETQFDAK

GTPFIAGKRIVPVIENHRFTGRYRDLYPANELIALLEEKGIVERDGSNIL

PKLLENDDSHAIDTMVALIRSVLQMRNSNAATGEDYINSPVRDLNGVCFD

SRFQNPEWPMDADANGAYHIALKGQLLLNHLKESKDLKLONGISNQDWLA

YIQELRNGGRSSDDEATADSQHAAPPKKKRKVGGSGGGSGGGSGGGRHHH

HHH
(MW = 155.7 kDa; pI = 8.34)
NLS sequence is underlined
Serine/glycine rich linkers are in bold
```

The sequences of the crRNA used was as follows:

```
- DNMT1 crRNA [SEQ ID NO: 157]:
5'- AAUUUCUACUGUUGUAGAUCUGAUGGUCCAUGUCUGUUACUC -3'
```

Figure 51K:
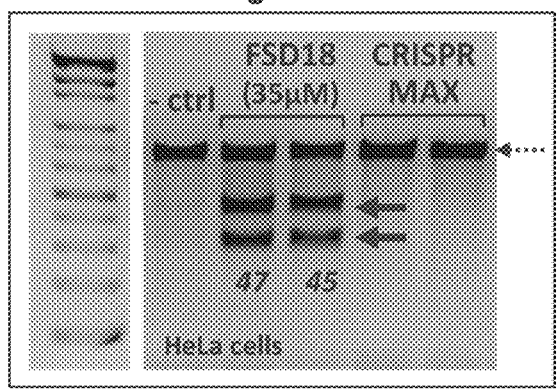
FIGS. 51K and 51L show the results of the cleavage of the targeted genomic DNMT1 DNA sequence with a CRISPR/Cpf1-NLS genome editing complex in the absence ("-ctrl") or presence of the shuttle agent FSD18 in HeLa (FIG. 51K) and NK cells (FIG. 51L), after PCR-amplification and separation by agarose gel electrophoresis. Thin dashed arrows indicate the bands corresponding to the target gene, and thick solid arrows indicate the bands corresponding to the CRISPR/Cpf1-NLS-mediated cleavage products of this target gene, which indicate the successful transduction of fully functional genome editing complexes. An imaging software was used to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thick solid arrows). No genomic DNA cleavage was observed using the lipofectamine-based transfection reagent CRISPRMAX™ to transduce the CRISPR/Cpf1-NLS genome editing complex.
Figure 51L:
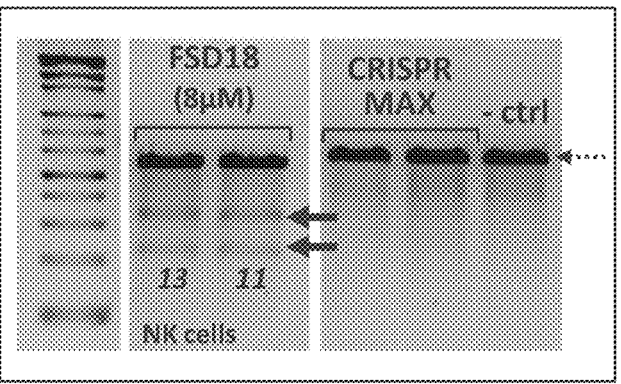

After 2 min (HeLa) or 90 sec (NK), cells were washed with PBS and harvested to proceed with the T7E1 protocol assay as described in Example 13.4. The PCR-amplified DNMT1 DNA sequence and the PCR-amplified cleavage product of this sequence were resolved on agarose gels and the results are shown in FIGS. 51K (HeLa cells) and 51L (NK cells). The negative control ("-ctrl") corresponds to cells that were exposed to CRISPR/Cpf1-NLS complex in the absence of the shuttle agent. Thin dashed arrows indicate the bands corresponding to the target gene, and thick solid arrows indicate the bands corresponding to the cleavage products of this target gene, which indicate the successful transduction of fully functional CRISPR/Cpf1-NLS genome editing complexes. The numerical value in italics at the bottom of each lane is the sum of the relative signals (%) of only the two cleavage product bands (thick solid arrows). These results show that FSD18 can transduce a functional CRISPR/Cpf1-NLS complex into the nucleus of these cells to effect cleavage of the target gene.

The CRISPRMAX™ technology is a commercially available lipofectamine-based transfection reagent optimized for CRISPR-Cas9 protein delivery. However, an equivalent reagent does not presently exist for the transduction of CRISPR-Cpf1. Interestingly, when we used the CRISPR-MAX™ reagent, it was unable to deliver the CRISPR/Cpf1-NLS complex in adherent and suspension cells. In contrast, FSD18 enabled a robust cleavage of the DNMT1 target in HeLa cells, and a lower but observable cleavage in NK cells.

These results show that the shuttle agent FSD18 successfully delivered a functional CRISPR/Cpf1-NLS complex to the nucleus of HeLa and NK cells, and that this delivery resulted in a CRISPR/Cpf1-NLS-mediated cleavage of genomic DNA.

Examples G.3-G.10

Rationally-Designed Peptide Shuttle Agents Enable Single or Multiple Gene Targeting, and/or Co-Delivery of Different CRISPR-Based Genome Editing Complexes These examples support the ability of rationally-designed peptide shuttle agents to enable the delivery and edition of multiple gene targets simultaneously. Functional CRISPR-based genome editing complexes were delivered to the nucleus of eukaryotic cells, and successful genome editing was evaluated using standard DNA cleavage assays. These assays were used to measure CRISPR/Cas9-mediated cleavage of cellular genomic DNA sequences HPRT (Hypoxanthine Phosphoribosyltransferase 1) and B2M (p2 microglobulin HLA subunit), and to measure CRISPR/Cpf1-mediated cleavage of cellular genomic DNA sequences NKG2A (Inhibitory NK cell receptor 2A), GSK3 (Glycogen Synthase Kinase 3), CBLB (E3 Ubiquitin-protein Ligase), DNMT1 (DNA (Cytosine-5-)-Methyltransferase 1) and B2M (p2 microglobulin HLA subunit). We also performed more complex genome editing approaches with the delivery of multiple CRISPR systems targeting one or two genes in the same cells. CRISPR/Cas9 and CRISPR/Cpf1 complexes were delivered together in HeLa cells to edit the HPRT and DNMT1 genes, respectively, or to edit the B2M gene in two different loci of exon 2. Finally, we co-delivered two CRISPR/Cpf1 complexes, each carrying a specific crRNA, to edit two exons in the B2M gene in NK cells.

G.3 Different Rationally-Designed Peptide Shuttle Agents Deliver CRISPR/Cas9-NLS and CRISPR/Cpf1 Complexes for B2M Gene Editing in HeLa, THP-1 and NK Cells Cas9-NLS recombinant protein was prepared as described in Example 13.1. Cpf1-NLS recombinant protein was prepared as described in Example G.2. A mix composed of a Cas9-NLS recombinant protein with its respective crRNAl-tracrRNA, or a Cpf1-NLS recombinant protein with its respective single guide crRNA(s) (see below) targeting a nucleotide sequence of the B2M gene, was co-incubated with different concentrations of the peptides FSD10, FSD18, FSD19, FSD21, FSD22, or FSD23 and incubated with HeLa, THP-1 or NK cells for 90 sec in PBS, or for 1 h in medium without serum, or for 48 h in medium with serum, using the transduction protocols as generally described in Example 3.1a. Cells were then washed with PBS and harvested to proceed with the T7E1 protocol assay as described in Example 13.4.

The sequences of the crRNAs and tracrRNAs constructed and their targets were:

```
- Feldan tracrRNA [SEQ ID NO: 77]:
5'- AAACAGCAUAGCAAGUUAAAAUAAGGCUAGUCCGUUAUCAACUU

GAAAAAGUGGCACCGAGUCGGUGCU -3'

- Cas9-flanked B2M-crRNA [SEQ ID NO: 160]:
5'- GAGTAGCGCGAGCACAGCTAGUUUUAGAGCUAUGCUGUUUUG -3'

- Cpf1-flanked B2M crRNA-1 [SEQ ID NO: 161]:
5'- AAUUUCUACUGUUGUAGAUAUCCAUCCGACAUUGAAGUU -3'

- Cpf1-flanked B2M crRNA-2 [SEQ ID NO: 162]:
5'- AAUUUCUACUCUUGUAGAUCCGAUAUUCCUCAGGUACUCCA -3'
```

Figure 52D:
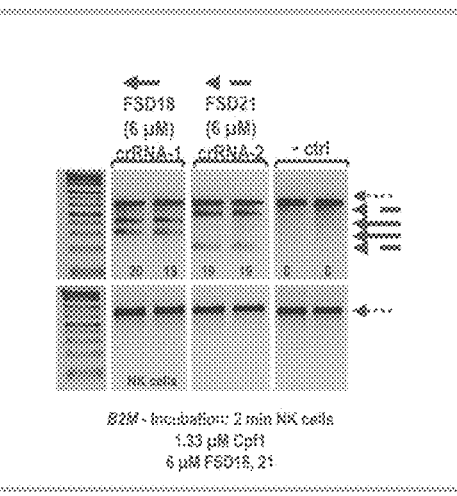
Figure 52E:
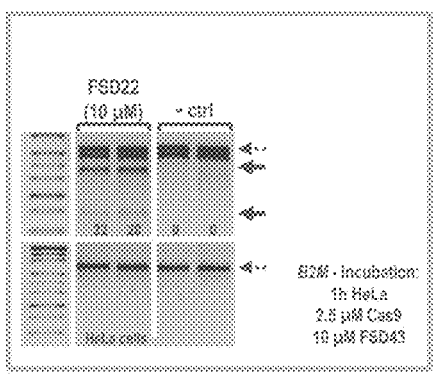
Figure 52J:
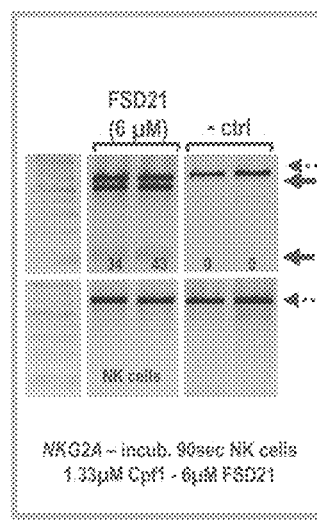
FIGS. 52J-52N show the results of the cleavage of a targeted genomic NKG2A DNA sequence with the CRISPR/Cpf1-NLS and a single guide crRNA in the absence ("-ctrl")
Figure 52K:
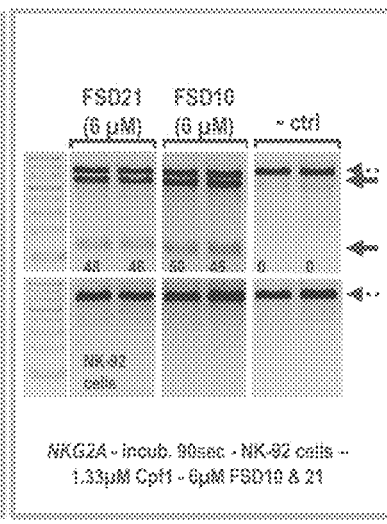
Figure 52L:
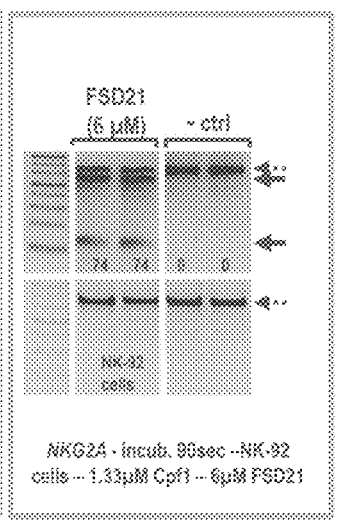
Figures 52M, 52N:
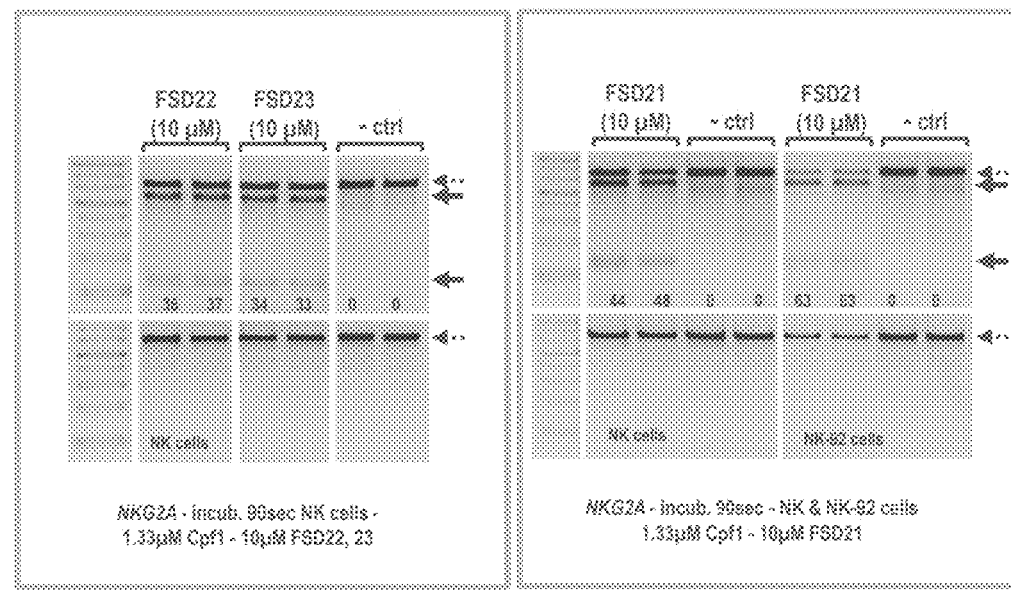

FIGS. 52A-52D show the results of the cleavage of the targeted genomic B2M DNA sequence after the delivery of CRISPR/Cpf1 (1.33 µM) with crRNA-1 or crRNA-2 (2 µM) in the absence ("-ctrl") or in the presence of the peptides FSD10, FSD18, FSD19, FSD21 or FSD23 used at different concentrations, exposure times, and in different types of cells: THP-1 (FIG. 52A), and NK (FIGS. 52B, 52C, 52D), after separation by agarose gel electrophoresis. FIG. 52D shows cleavage products of the genomic B2M exon 2 DNA sequence after the delivery of a CRISPR/Cpf1 complex carrying a specific single guide RNA (crRNA-1 or crRNA-2) in presence of FSD18 or FSD21, respectively. FIG. 52E shows the cleavage product of the genomic B2M exon 2 DNA sequence with CRISPR/Cas9 (2.5 µM) and crRNA (2 µM) in the absence ("-ctrl") or in the presence of the peptide FSD22 used at 10 µM for 1 h in HeLa cells, after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes. We used a Bio-Rad ImageLab™ software (Version 5.2.1, Bio-Rad, http://www.bio-rad.com/en-ca/product/image-lab-software?tab=Download) to quantify the relative signal intensities of each of the different bands directly on the gels. The sum of all the bands in a given lane corresponds to 100% of the signal, and the numerical value in italics at the bottom of each lane is the sum of the relative signals (%) of only the two cleavage product bands (thick solid arrows). No cleavage product bands were found in the negative controls ("-ctrl", i.e., to cells that were exposed to CRISPR system in the absence of FSD peptide). These results indicate the successful delivery of the CRISPR genome-editing complexes to the nucleus, resulting in cleavage of the target gene.

G.4 Different Rationally-Designed Peptide Shuttle Agents Deliver CRISPR/Cpf1 Systems for GSK3, CBLB and DNMT1 Gene Editing in NK, THP-1 and Primary Myoblasts Cells.

Cpf1-NLS recombinant protein was prepared as described in Example G.2. A mix composed of a Cpf1-NLS recombinant protein with a single guide crRNA (see below) targeting a nucleotide sequence of the GSK3, CBLB or DNMT1 genes was co-incubated with different concentrations of FSD10, FSD18, FSD19 or FSD23 and incubated with NK cells for 48 h in medium with serum, and in THP-1 or in primary myoblasts cells for 90 sec in PBS, using the transduction protocols as generally described in Example 3.a. Cells were then washed with PBS and harvested to proceed with the T7E1 protocol assay as described in Example 13.4.

The sequences of the crRNA constructed and their targets were:

```
- GSK3 crRNA [SEQ ID NO: 163]:
5'- AAUUUCUACUCUUGUAGAUCUUUCUUCCUUUAGGAGACA -3'

- CBLB crRNA [SEQ ID NO: 164]:
5'- AAUUUCUACUCUUGUAGAUAAGAACUAAAAUUCCAGAUG -3'

- DNMT1 crRNA [SEQ ID NO: 157]:
5'- AAUUUCUACUGUUGUAGAUCUGAUGGUCCAUGUCUGUUACUC -3'
```

FIGS. 52F-52I show the results of the cleavage of the targeted genomic GSK3, CBLB and DNMT1 DNA sequences with the CRISPR/Cpf1 (1.33 µM) and crRNA (2 µM) in absence ("-ctrl") or presence of the shuttle agents FSD10, FSD18, FSD19 or FSD23 used at different concentrations, exposure times, and in different types of cells: NK (FIGS. 52F and 52G), THP-1 (FIG. 52H) and primary myoblasts (FIG. 52I) after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes.

G.5 Different Rationally-Designed Peptide Shuttle Agents Deliver CRISPR/Cpf1 Systems for NKG2A Gene Editing in Nk Cells.

Cpf1-NLS recombinant protein was prepared as described in Example G.2. A mix composed of a Cpf1-NLS recombinant protein with a single guide crRNA (see below) targeting a nucleotide sequence of the NKG2A gene was co-incubated with different concentrations of FSD10, FSD21, FSD22 or FSD23 and incubated with NK and NK-92 cells for 90 sec in PBS, using the transduction protocols as generally described in Example 3.1a. Cells were then washed with PBS and harvested to proceed with the T7E1 protocol assay as described in Example 13.4.

The sequences of the crRNA constructed and their targets were:

```
- NKG2A crRNA [SEQ ID NO: 165]:
5'- AAUUUCUACUCUUGUAGAUGGGGCAGAUUCAGGUCUGAG -3'
```

FIGS. 52J-52N show the results of the cleavage of the targeted genomic NKG2A DNA sequence with the CRISPR/Cpf1 (1.33 µM) and crRNA (2 µM) in absence ("-ctrl") or presence of the shuttle agents FSD10, FSD21, FSD22 or FSD23 used at different concentrations, exposure times, and in NK and NK-92 cells after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes.

G.6 Different Rationally-Designed Peptide Shuttle Agents Co-Deliver CRISPR/Cas9 and CRISPR/Cpf1 Complexes for HPRT, DNMT1 and B2M Gene Editing in HeLa and NK Cells Cas9-NLS recombinant protein was prepared as described in Example 13.1. Cpf1-NLS recombinant protein was prepared as described in Example G.2. A mix composed of Cas9-NLS recombinant protein with its respective crRNA1-tracrRNA, or Cpf1-NLS recombinant protein with its respective single guide crRNA(s) (see below) targeting a nucleotide sequence of the DNMT1, HPRT and B2M genes, was co-incubated with different concentrations of FSD10, FSD18, FSD21 or FSD23, and incubated with HeLa or NK cells for 90 sec or 2 min in PBS using the transduction protocols as generally described in Example 3.1a. Cells were then washed with PBS and harvested to proceed with the T7E1 protocol assay as described in Example 13.4.

The sequences of the crRNA and tracrRNAs constructed and their targets were:

```
- Feldan tracrRNA [SEQ ID NO: 77]:
5'- AAACAGCAUAGCAAGUUAAAAUAAGGCUAGUCCGUUAUCAACUUG
AAAAAGUGGCACCGAGUCGGUGCU-3'

- HPRT crRNA [SEQ ID NO: 103]:
5'- AAUUAUGGGGAUUACUAGGAGUUUUAGAGCUAUGCU-3'

- DNMT1 crRNA [SEQ ID NO: 157]:
5'- AAUUUCUACUGUUGUAGAUCUGAUGGUCCAUGUCUGUUACUC -3'

- Cas9-flanked B2M-crRNA [SEQ ID NO: 160]:
5'- GAGUAGCGCGAGCACAGCTAGUUUUAGAGCUAUGCUGUUUUG -3'

- Cpf1-flanked B2M crRNA-1 [SEQ ID NO: 161]:
5'- AAUUUCUACUGUUGUAGAUAUCCAUCCGACAUUGAAGUU -3'

- Cpf1-flanked B2M crRNA-2 [SEQ ID NO: 162]:
5'- AAUUUCUACUCUUGUAGAUCCGAUAUUCCUCAGGUACUCCA -3'
```

Figures 53A, 53B:
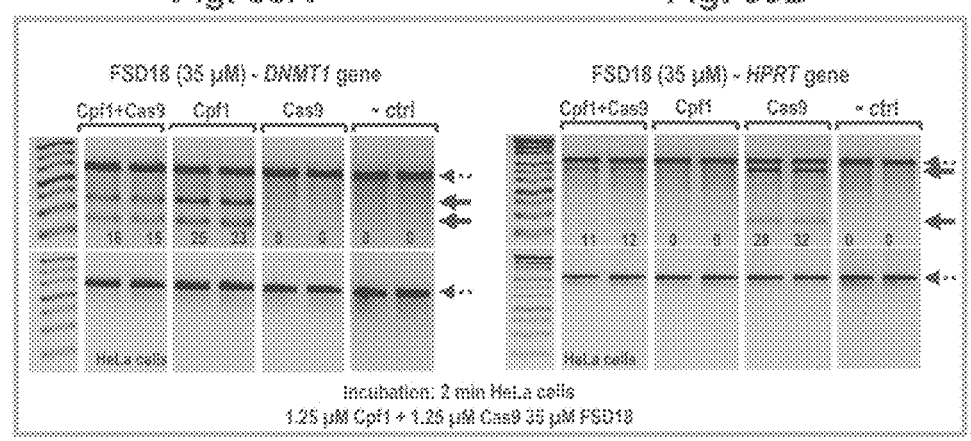
Figures 53C, 53D:
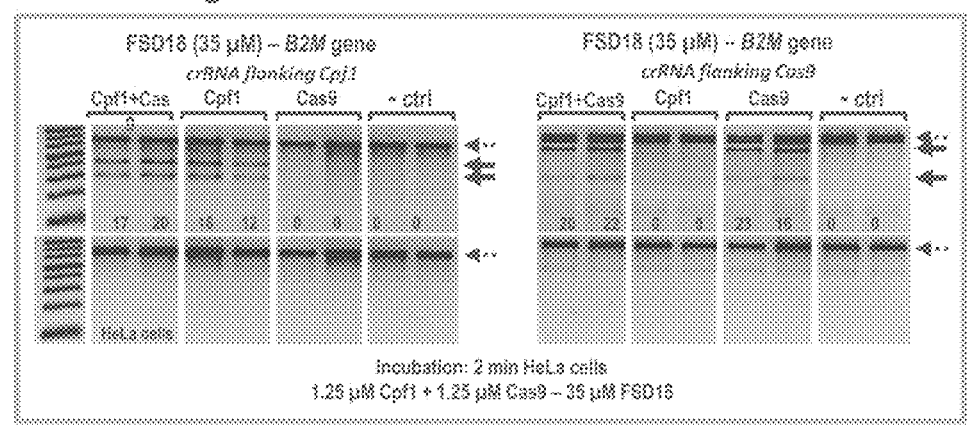
Figure 53E:
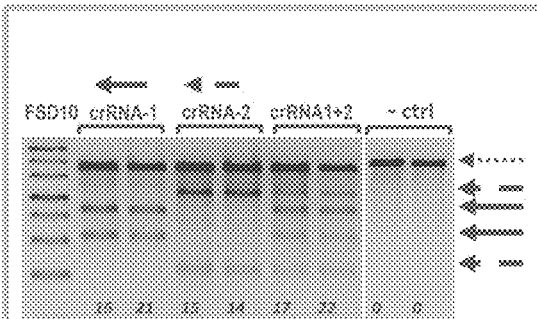

FIGS. 53A-53G show the results of the cleavage of the targeted genomic DNMT1, HPRT and B2M DNA sequences with different CRISPR systems in the absence ("-ctrl") or in the presence of the shuttle agents FSD10, FSD18, FSD21 or FSD23 used at different concentrations, exposure times, and in HeLa and NK cells after separation by agarose gel electrophoresis. FIG. 53A shows DNMT1 DNA cleavage products from the same genomic DNA extract after the co-delivery of a DNMT1-targeting CRISPR/Cpf1 (1.25 µM) complex and a HPRT-targeting CRISPR/Cas9 (1.25 µM) complex in HeLa cells. FIG. 53B shows HPRT DNA cleavage products from the same genomic DNA extract after the co-delivery of a DNMT1-targeting CRISPR/Cpf1 (1.25 µM) complex and a HPRT-targeting CRISPR/Cas9 (1.25 µM) complex in HeLa cells. FIG. 53C shows the cleavage products of the B2M exon 2 from the same genomic DNA extract after the co-delivery of a CRISPR/Cpf1 (1.25 µM) and a CRISPR/Cas9 (1.25 µM) in HeLa cells. Each complex targeted a different locus in the B2M exon 2 via a specific crRNA flanking Cpf1. FIG. 53D shows the cleavage products of the B2M exon 2 from the same genomic DNA extract after the co-delivery of a CRISPR/Cpf1 (1.25 µM) and a CRISPR/Cas9 (1.25 µM) in HeLa cells. Each complex targeted a different locus in the B2M exon 2 via a specific crRNA flanking Cas9.FIG. 53E shows the results of the cleavage of the B2M exon 2 from genomic extracts after the co-delivery of CRISPR/Cpf1 (1.33 µM) complexes, each one carrying a specific single guide crRNA-1 or crRNA-2 (2 µM) in presence of FSD10. For each experiment, NK cells were exposed to CRISPR/Cpf1 with crRNA-1 or CRISPR/

Figure 53F:
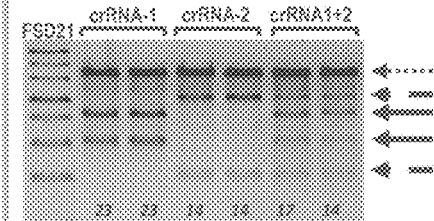
Figure 53G:
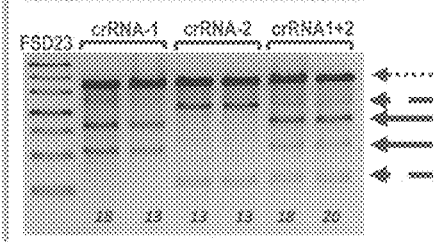

Cpf1 with crRNA-2, or both complexes. FIG. 53F shows the results of the cleavage of the B2M exon 2 from genomic extracts after the co-delivery of CRISPR/Cpf1 (1.33 µM) complexes, each one carrying a specific single guide crRNA-1 or crRNA-2 (2 µM) in presence of FSD21. For each experiment, NK cells were exposed to CRISPR/Cpf1 with crRNA-1 or CRISPR/Cpf1 with crRNA-2, or both complexes. FIG. 53G shows the results of the cleavage of the B2M exon 2 from genomic extracts after the co-delivery of CRISPR/Cpf1 (1.33 µM) complexes, each one carrying a specific single guide crRNA-1 or crRNA-2 (2 µM) in presence of FSD23. For each experiment, NK cells were exposed to CRISPR/Cpf1 with crRNA-1 or CRISPR/Cpf1 with crRNA-2, or both complexes.

G.7 Different Rationally-Designed Peptide Shuttle Agents Deliver CRISPR/Cpf1 Complexes for B2M Gene Editing in T Cells-Flow Cytometry Analysis Cpf1-NLS recombinant protein was prepared as described in Example G.2.

Unless otherwise specified, T cells used herein were obtained from healthy human blood collected in heparinized tubes. T cells were isolated using a Ficoll™ technique (Ficoll-Paque™ GE or Lymphoprep™ Stem Cell Technologies). Briefly, blood was mixed with the Ficoll™ solution in conical tubes (50 mL) and centrifuged at 2280 rpm for 20 minutes. Mononuclear cells were harvested and transferred in another conical tube (50 mL) before washing with PBS and centrifugation at 1100 rpm for 10 minutes. Cells were resuspended in 5 mL of PBS containing 20% FBS. Cells were counted and then incubated in a culture medium composed by RPMI advanced (cat: 12633012 ThermoFisher), 10% FBS, 1% Penstrep (15140122 ThermoFisher), 1% L-glutamine (25030081 ThermoFisher) IL-2 30U/ml). Next, T cells were enriched with a Human T cell Enrichment Kit (StemCell #cat: 19051) by negative selection following the manufacturer instructions. The enriched T cells were validated using a specific anti-CD3 antibody (Biolegend #cat: 300438). At this step, collected cells were typically around 99% T cells. T cells were activated by adding IL-2 at 30 U/mL and the anti-CD28 antibody (ThermoFisher #cat: 16-0289-85) in complete medium for 5 days prior to experimentation. The activation of T cell expansion was then double-checked with both anti-CD25 and anti-CD137 antibodies.

A mix composed of a Cpf1-NLS recombinant protein with respective single guide crRNA(s) targeting a nucleotide sequence of the B2M gene was co-incubated with different concentrations of FSD21 or FSD18 peptide shuttle agents and incubated with T cells for 90 seconds in PBS using the transduction protocols as generally described in Example 3.1a. Each of the B2M crRNAs were designed to mediate CRISPR/Cpf1-based cleavage of the B2M gene, the phenotypic effects of which can be seen by the disruption of cell surface HLA, which is detectable by flow cytometry using a fluorescent APC Mouse Anti-Human HLA-ABC antibody.

The cells were then resuspended in 100 µL PBS containing 1% FBS and 4 µL of APC Mouse Anti-Human HLA-ABC antibody before an incubation period of 20 minutes, in the dark, at ambient temperature. Then, 1 mL of PBS containing 1% FBS was added to the suspension followed by a 1200 rpm centrifugation of 5 minutes. Finally, the pellet was resuspended in 100 to 200 µL of PBS containing 1% FBS before flow cytometry analysis.

Flow cytometry results based on cell size and granularity using respectively the Forward Scatter (FSC) and the Side Scatter (SSC) parameters showed that viability of the transduced T cells was not substantially affected by the co-delivery of different tested concentrations of FSD21 or FSD18 peptide shuttle agents with CRISPR/Cpf1 systems (data not shown).

Figure 55A:
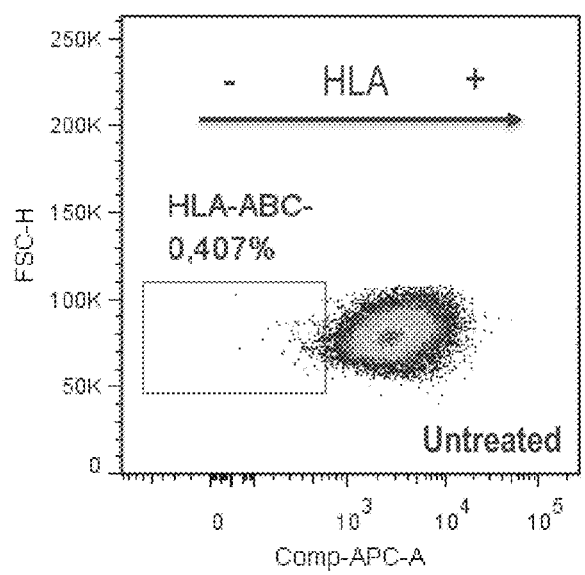
Figure 55B:
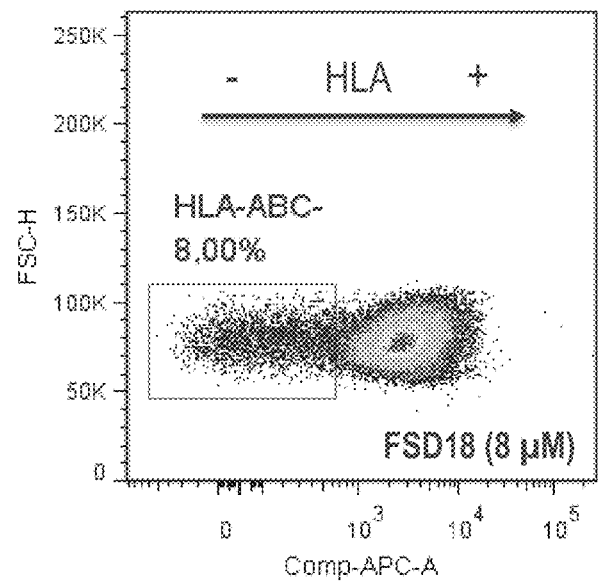
Figure 55C:
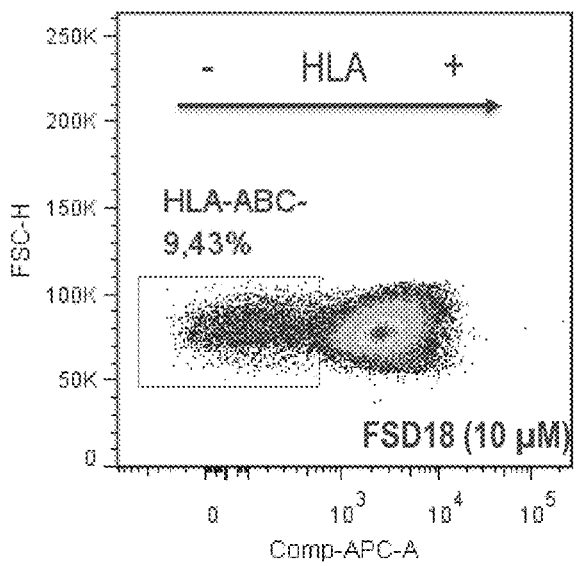
Figure 55D:
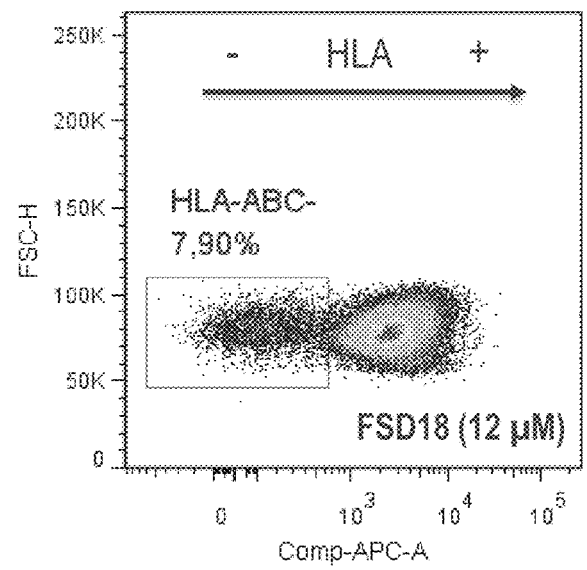

FIGS. 54A-54D and 55A-55D show delivery of CRISPR/Cpf1 genome editing complexes via the shuttle peptides FSD21 and FSD18, respectively. As seen in FIGS. 54A and 55A, "untreated" negative control cells, which were not exposed to CRISPR/Cpf1 or shuttle peptide, exhibited no significant genome editing (lack of HLA-negative cells). FIGS. 54B-54D show that FSD21 concentrations of 8, 10 and 12 µM resulted in 9.87%, 8.68%, and 12.2% of HLA-negative cells, indicating successful nuclear delivery of functional CRISPR/Cpf1 genome editing complexes and subsequent genome editing. FIGS. 55B-55D show that FSD18 concentrations of 8, 10 and 12 µM resulted in 8.0%, 9.43%, and 7.9% of HLA-negative cells, indicating successful nuclear delivery of functional CRISPR/Cpf1 genome editing complexes and subsequent genome editing.

G.8 Transduction of CRISPR/Cpf1 Complexes Containing Multiple Guide crRNA Targeting B2M in THP-1 Cell Lines Using a Single Rationally-Designed Peptide Shuttle Agent Cpf1-NLS recombinant protein was prepared as described in Example G.2. A mix composed of a Cpf1-NLS recombinant protein with a single guide crRNA (see below) targeting one of three chosen nucleotide sequences of the B2M gene was co-incubated with (3 µM) of FSD18 and incubated with THP-1 cells for 90 seconds in PBS, using the transduction protocols as generally described in Example 3.1a. The same experiments were performed using a mix composed of a Cpf1-NLS recombinant protein with three guide crRNA (see below), each targeting three different nucleotide sequences of the B2M gene. Flow cytometry experiments were performed as described in Example G.7. Also, to proceed with the T7E1 protocol assay as described in Example 13.4, cells were washed with PBS and harvested.

The sequences of the crRNA constructed and their targets were:

- B2M crRNA-E [SEQ ID NO: 166]:
5'- AAUUUCUACUCUUGUAGAUAUCCAUCCGACAUUGAAGUU -3'

- B2M crRNA-J [SEQ ID NO: 167]:
5'- AAUUUCUACUCUUGUAGAUCCGAUAUUCCUCAGGUACUCCA -3'

- B2M crRNA-G [SEQ ID NO: 168]:
5'- AAUUUCUACUCUUGUAGAUUUAGAGUCUCGUGAUGUUUAAG -3'

Flow cytometry results based on cell size and granularity using respectively the Forward Scatter (FSC) and the Side Scatter (SSC) parameters show that the viability of the transduced THP-1 cells was not substantially affected by the presence of CRISPR/Cpf1 systems comprising the guide crRNAs (RNA-E, RNA-G, RNA-J) used separately or in combination (data not shown).

As shown in FIG. 56A, "untreated" negative control cells, which were not exposed to CRISPR/Cpf1 or shuttle peptide, exhibited no significant genome editing (lack of HLA-negative cells). FIGS. 56B-56D show that each guide crRNA (RNA-E, RNA-G, RNA-J) used separately provided comparable HLA KO efficiencies, while FIG. 56E shows the combination the three guides crRNA enhanced the HLA KO efficiency by almost a factor of two. These observations were confirmed by performing a T7E1 cleavage assay as described in Example 13.4, followed by agarose gel electrophoresis (data not shown).

G.9 Increased Cytotoxicity of NK Cells Genome-Edited to Inactive the NKG2A Gene

Genome editing was performed in NK-92 cells to evaluate whether inactivation of the endogenous NKG2A gene could increase the cytotoxicity of the NK-92 cells. Briefly, one million NK-92 cells were incubated with Cpf1-NLS (1.5 µM) gRNA complex targeting the NKG2A gene and with FSD23 (6 µM) for 90 sec. After transduction, cells were incubated in complete medium with IL-2 (20 ng/mL) for 48 h at 37° C. NK-92 cells were then immunolabelled with a phycoerythrin (PE)-labelled anti-NKG2A antibody (Miltenyi Biotec #CD159a) following the manufacturer recommendations. NK-92 cells were then analyzed with FACS and scored as a function of their anti-NKG2A detection (PE fluorescence) level and the results are shown in FIG. 57A. As controls, unlabelled wild-type NK-92 cells ("unlabelled WT cells") had no antibody signal, and labelled wild-type NK-92 cells ("labelled WT cells") had full immunolabelling signal. For NKG2A-KO NK-92 cells, two cell populations (peaks) were observed: one with a complete knock-out of NKG2A receptor expression on the cell surface ("Complete NKG2A KO cells"), and the other with a partial lack of expression ("Partial NKG2A KO cells").

To study the effect of inactivation of the NKG2A gene on the cytotoxicity of the NK-92 cells, we evaluated the ability of WT and NKG2A KO NK-92 cells to kill target HeLa cells. The NKG2A receptor encoded by the NKG2A gene in NK cells normally binds HLA-E epitopes expressed on the surface of potential target cells, which inhibits the cytotoxic activity of the NK cells (effector). To improve this effector:target cell binding, HeLa cells were treated with interferons (50 ng/mL) to increase their HLA-E cell surface expression. Prior to being exposed to effector NK-92 cells, interferon-treated HeLa cells were exposed for 45 minutes at 37° C. to Calcein-AM (ThermoFisher #C3099), a non-fluorescent, hydrophobic compound that easily permeates intact live cells. The hydrolysis of Calcein-AM by intracellular esterases produces Calcein, a hydrophilic, strongly fluorescent compound that is well-retained in the cell cytoplasm. HeLa cells with intracellular Calcein were then centrifuged and incubated in complete medium before being exposed to WT or NKG2A-KO NK cells in a 96-well plate for 4 hrs at 37° C. Killing of the target HeLa cells by effector NK cells results in release of the intracellular Calcein into the extracellular medium. The 96-well plate was then centrifuged for 5 minutes at 1250 rpm and the Calcein signal in the supernatant was analyzed by spectrophotometry with excitation at 488 nm and detection at 510 nm. Results are shown in FIG. 57B, which presents the percentage of lysis of the target HeLa cells (measured by Calcein release) as a function of different ratios of effector NK cells to target HeLa cells (E:T ratio). The results indicate that the knock out of the NKG2A receptor expression on the surface of NK-92 cells ("NK92 NKG2A-KO") increased the cytotoxic activity of the effector cells as compared to wild-type NK-92 cells ("NK92-WT"). More specifically, NKG2A-KO NK-92 effector cells killed 10-15% more target HeLa cells than WT NK-92 cells at the different effector:target ratios (E:T ratios) tested.

G.10 Different Rationally-Designed Peptide Shuttle Agents Deliver CRISPR/Cpf1 Systems for B2M and NKG2A Gene Editing in HeLa and NK-92 Cells.

Cpf1-NLS recombinant protein was prepared as described in Example G.2. A mix composed of a Cpf1-NLS recombinant protein with a single guide crRNA (see below) targeting a nucleotide sequence of the B2M or the NKG2A genes was co-incubated with 20 NM or 6 µM of the indicated peptide and incubated with HeLa or NK-92 cells, respectively, for 1 min in PBS, using the transduction protocols as generally described in Example V.a. Cells were then washed with PBS and harvested to proceed with the T7E1 protocol assay as described in Example 13.4. The crRNA constructed and their targets were: B2M crRNA-G (SEQ ID NO: 168) and NKG2A crRNA (SEQ ID NO: 165).

Table G1 shows the percentage insertions and deletions (% INDELs) resulting from cleavage of the targeted genomic B2M and NKG2A DNA sequences with CRISPR/Cpf1 (1.33 µM) and crRNA (2 µM), which were transduced with the indicated peptides used at different concentrations in HeLa and NK-92 cells after T7E1 assay and direct quantification on agarose gel electrophoresis (n=2). The peptide FSD67, which failed to respect parameter (5) (low hydrophobic moment), failed to transduce CRISPR/Cpf1.

| Cells | Peptides | Gene target | % INDELs | Design parameters |
|---|---|---|---|---|
| HeLa | FSD43 | B2M | 50 | OK |
|  | FSD44 |  | 74 | OK |
|  | FSD45 |  | 45 | OK |
|  | FSD46 |  | 74 | OK |
|  | FSD47 |  | 55 | OK |
|  | FSD48 |  | 46 | OK |
|  | FSD49 |  | 27 | OK |
|  | FSD50 |  | 63 | OK |
|  | FSD51 |  | 65 | OK |
|  | FSD61 |  | 65 | OK |
|  | FSD62 |  | 65 | OK |
|  | FSD63 |  | 70 | OK |
|  | FSD99 |  | 49 | OK |
| NK-92 | FSD115 | B2M | 15 | OK |
|  | FSD99 | crRNA-G | 32 | OK |
|  | FSD44 |  | 19 | OK |
|  | FSD61 |  | 23 | OK |
|  | FSD63 |  | 10 | OK |
|  | FSD67 |  | 0 | Low hydrophobic moment (µH = 2.47) |
|  | FSD68 |  | 8 | No hydrophobic core |
|  | FSD69 |  | 23 | OK |
|  | FSD70 |  | 28 | OK |
|  | FSD71 |  | 15 | OK |
|  | FSD100 | NKG2A | 16 | OK |
|  | FSD101 |  | 17 | OK |

OK = peptide sequence respects parameters (1)-(15).

Example H

Rationally Designed Peptide Shuttle Agents Enable Transduction of Transcription Factor HOX64

Human HOXB4 recombinant protein (Example 14.1) was constructed, expressed and purified from a bacterial expression system as described in Example 1.4. THP-1 cells were cultured and tested in the protein transduction assay as generally described in Example 3.1b. Briefly, THP-1 cells were plated at 30 000 cells/well one day before transduction. HOXB4-WT recombinant protein (300 nM or 50 nM) was co-incubated with FSD10 or FSD18 (1 µM) and then exposed to THP-1 cells for 30 min in the presence of serum. The cells were subjected to real time-PCR analysis as described in Example 14.2 to measure the mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown below.

TABLE H1

HOXB4-WT transduction by FSD10 and FSD18 in THP-1 cells

| Cells | Cargo/peptide | Conc. of peptide (µM) | Conc. of HOXB4-WT (µM) | Fold over control (mean ± St. Dev) | Total RNA in ng/µL (mean ± St. Dev) |
|---|---|---|---|---|---|
| THP-1 | No treatment | 0 | 0 | 1 ± 0.1 | 172 ± 9.21 |
| | HOXB4-WT alone | | 1.5 | 2.5 ± 0.2 | 175 ± 7.05 |
| | FSD10 alone | 1 | 0 | 1.1 ± 0.14 | 181 ± 10.7 |
| | FSD18 alone | | | 1.5 ± 0.09 | 157 ± 3.9 |
| | FSD10 + HOXB4-WT | | 0.3 | 17.5 ± 0.21 | 159 ± 12.5 |
| | | | 0.05 | 15.3 ± 0.3 | 176 ± 4.71 |
| | FSD18 + HOXB4-WT | | 0.3 | 15.8 ± 0.19 | 154 ± 11.24 |
| | | | 0.05 | 16.7 ± 15.61 | 154 ± 3.9 |

These results show that the shuttle agents FSD10 and FSD18 are able to deliver the transcription factor HOXB4-WT to the nucleus of THP-1 cells in the presence of serum, resulting in a dose-dependent increase in mRNA transcription of the target gene.

Example I

Co-Transduction with an Independent Fluorescent Protein Marker Enables Isolation of Successfully Transduced Cells The ability of domain-based and rationally-designed peptide shuttle agents described herein to co-transduce two different polypeptide cargos simultaneously is shown in Example 9.6 (i.e., co-transduction of the fluorescent proteins GFP-NLS and mCherry-NLS) and in Example G.6 (i.e., co-transduction of the genome editing complexes CRISPR/Cas9 and CRISPR/Cpf1).

The results presented in Example I demonstrate the successful co-transduction of a fluorescent protein marker (e.g., GFP-NLS) and a genome editing complex (e.g., CRISPR/Cpf1). Surprisingly, although co-transduction with the fluorescent protein marker was not found to significantly increase overall genome-editing efficiency per se, a strikingly high proportion of cells positive for genome-engineering were positive for the fluorescent protein marker. Isolating cells positive for the fluorescent protein marker resulted in a significant increase in the proportion of successfully genome-edited cells. Furthermore, the correlation was found to be concentration specific in that cell populations exhibiting the highest fluorescence of the protein marker also exhibited the highest proportion of successful genome-editing.

1.1 Enrichment of Genome-Edited T Cells by FACS Following Co-Transduction of CRIPSR/Cpf1-NLS and GFP-NLS Cpf1-NLS recombinant protein was prepared as described in Example G.2 and GFP-NLS recombinant protein was prepared as described in Example 5.1.

Unless otherwise specified, T cells used herein were obtained from healthy human blood collected in heparinized tubes. T cells were isolated using a Ficoll™ technique (Ficoll-Paque™ GE or Lymphoprep Stem Cell Technologies). Briefly, blood was mixed with the Ficoll™ solution in conical tubes (50 mL) and centrifuged at 2280 rpm for 20 minutes. Mononuclear cells were harvested and transferred in another conical tube (50 mL) before washing with PBS and centrifugation at 1100 rpm for 10 minutes. Cells were resuspended in 5 mL of PBS containing 20% FBS. Cells were counted and then incubated in a culture medium composed by RPMI advanced (cat: 12633012 ThermoFisher), 10% FBS, 1% Penstrep (15140122 ThermoFisher), 1% L-glutamine (25030081 ThermoFisher) IL-2 30U/ml). Next, T cells were enriched with a Human T cell Enrichment Kit (StemCell #cat: 19051) by negative selection following the manufacturer instructions. The enriched T cells were validated using a specific anti-CD3 antibody (Biolegend #cat: 300438). At this step, collected cells were typically around 99% T cells. T cells were activated by adding IL-2 at 30 U/mL and the anti-CD28 antibody (ThermoFisher #cat: 16-0289-85) in complete medium for 5 days prior to experimentation. The activation of T cell expansion was then double-checked with both anti-CD25 and anti-CD137 antibodies.

T cells were transduced with a CRISPR/Cpf1 complex comprising a guide RNA (B2M crRNA-E, SEQ ID NO: 166) designed to cleave and inactivate the B2M gene as generally described in Example G.2, resulting in the inactivation of cell surface HLA in genome-edited cells. Briefly, 4 million of activated T cells were used for each condition. In one experimental condition, cells were treated with a mix containing the peptide FSD18 at 15 µM and the CRISPR/Cpf1-NLS complex just before incubation with cells for 90 seconds. In a second experimental condition, GFP-NLS (20 µM) was added to the mix containing FSD18 at 15 µM and the CRISPR/Cpf1-NLS complex just before incubation with cells for 90 seconds. Untreated cells were used as negative control. After transduction, cells were washed and resuspended in culture media. Untreated cells and cells treated with the CRISPR/Cpf1-NLS complex were incubated in complete media for 48 hours before flow cytometry and T7E1 analysis. A first part of the cells treated with CRISPR/Cpf1-NLS and GFP-NLS complex were incubated for 48 hours in T cell medium before flow cytometry and T7E1 analysis. The second part of cells were centrifugated and resuspended in PBS with 1% serum. GFP positive (+) and GFP negative (−) cells were separated using cell sorters based on the fluorescence signal and fractions were collected and incubated for 48 hours in T cell medium before flow cytometry and T7E1 analysis.

Results are shown in FIGS. 58A-58F, in which quadrant 1 (Q1) represents cells that are HLA-positive (non-genome edited) and GFP-negative; quadrant 2 (Q2) represents cells that are HLA-positive (non-genome edited) and GFP-positive; quadrant 3 (Q3) represents cells that are HLA-negative (successfully genome edited) and GFP-positive; and quadrant 4 (Q4) represents cells that are HLA-negative (successfully genome edited) and GFP-negative. Flow cytometry results based on cell size and granularity using respectively the Forward Scatter (FSC) and the Side Scatter (SSC) parameters showed that co-delivery of GFP-NLS and CRISPR/Cpf1 systems under the tested conditions did not significantly affect the viability of the transduced T cells (data not shown).

As shown in FIG. 58A, "untreated" negative control cells not exposed to the peptide shuttle agent, GFP, nor CRISPR/Cpf1 resulted in 99% of cells in Q1 (non-genome edited, GFP-negative). FIG. 58B shows that cells exposed to the peptide FSD18 (15 µM) and CRISPR/Cpf1 in the absence of GFP-NLS resulted in 10.1% of cells in Q4—i.e., being HLA-negative (successfully genome-edited) and GFP-negative. FIG. 58C shows that cells exposed to both GFP-NLS and CRISPR/Cpf1 in the presence of the peptide FSD18, resulted in 65.7% (54.4%+11.3%) GFP-positive cells in Q2+Q3, and 11.7% (0.441%+11.3%) HLA-negative cells (successfully genome-edited) in Q3+Q4. Comparing FIGS. 58B and 58C, the presence or absence of GFP was not found to significantly increase overall genome editing efficiency (10.1% versus 11.7% of HLA-negative cells). Surprisingly, it was observed that over 96% of genome-edited cells (HLA-negative) were GFP-positive as well [FIG. 58C, Q3/(Q3+Q4)]. Fluorescence-activated cell sorting (FIG. 58D) of cells based on their GFP-fluorescence into a GFP-negative fraction (FIG. 58E) and a GFP-positive fraction (FIG. 58F) resulted in an increase in the proportion of genome-edited (HLA-negative) cells to 29.7% in the GFP-positive fraction (FIG. 58F). Strikingly, the proportion of genome-edited (HLA-negative) cells in the GFP-negative fraction (FIG. 58E) was less than 0.1%.

Each cell fraction was then subjected to the T7E1 cleavage assay as described in Example 13.4, and the different samples were subjected to agarose gel electrophoresis. The results are shown in FIG. 58G, wherein thin dashed arrows indicate the bands corresponding to the target gene, and thicker solid arrows indicate the bands corresponding to the CRISPR system-mediated cleavage products of this target gene, which indicate the successful transduction of fully functional CRISPR/Cpf1-NLS genome editing complexes. As can be seen in FIG. 58G, the GFP-positive cell fractions ("GFP+cells"; lane 4) had increased genome-editing efficiency as compared to cells before sorting ("no cell sorting"; lane 3). Peptide FSD18 and the CRISPR/Cpf1-NLS complex with GFP-NLS (lane 3) and without GFL-NLS (lane 2) showed the same genome editing level, indicating that the addition of GFP-NLS does not affect the transduction process. GFP-negative cell fractions (lane 5), and negative control ("untreated"; lane 1) demonstrated no detectable genome editing.

1.2 Further Enrichment of Genome-Edited T Cells by FACS Following Co-Transduction of CRIPSR/Cpf1-NLS and GFP-NLS The experiment described in Example 1.1 was repeated on activated T cells using 12 µM or 15 µM of the peptide FSD18. Since both concentrations of FSD18 produced similar results, only the results using 15 µM of FSD18 are shown herein. Flow cytometry results based on cell size and granularity using respectively the Forward Scatter (FSC) and the Side Scatter (SSC) parameters showed that co-delivery of GFP-NLS and CRISPR/Cpf1 systems under the tested conditions did not significantly affect the viability of the transduced T cells (data not shown).

FIGS. 59A and 59B, show the results of "untreated" negative control cells not exposed to the peptide shuttle agent, GFP, nor CRISPR/Cpf1, which were analyzed by flow cytometry for GFP fluorescence (FIG. 59A) and cell surface HLA expression (FIG. 59B). T cells were co-transduced with both GFP-NLS and CRISPR/Cpf1 via the peptide FSD18 (15 µM) and sorted based on their fluorescence signal, and cell fractions were collected and incubated for 48 hours. The resulting fraction of cells sorted for GFP fluorescence distribution is shown in FIG. 59C. The two gates in FIG. 59C indicate the fraction of cells that were considered to be GFP-positive ("GFP+"; 93.2%) and the sub-fraction of cells that were considered as exhibiting high GFP fluorescence ("GFP high"; 33.1%). Fluorescence-activated cell sorting analysis was performed to quantify the level of cell surface HLA expression in cells considered to be GFP-positive (FIG. 59D) as compared to cells considered as exhibiting high GFP fluorescence (FIG. 59E). As can be seen in FIG. 59D, 21.8% of GFP-positive cells were HLA-negative (successfully genome-edited), whereas this value rose to a striking 41.6% amongst cells exhibiting high GFP fluorescence (FIG. 59E). Thus, the proportion of successfully genome-edited (HLA-negative) cells increased with the fluorescence level of the fluorescent protein marker (GFP-NLS).

The above co-transduction experiment was repeated using 12 µM or 15 µM FSD18, followed by fluorescence-activated cell sorting into GFP-positive and GFP-negative cell fractions. Each fraction was subjected to the T7E1 cleavage assay as described in Example 13.4, and the different samples were subjected to agarose gel electrophoresis. Consistent with the results of the flow cytometry experiments described above, the results from T7E1 cleavage assays showed that the GFP-positive cell fractions had increased genome-editing efficiency as compared to in the GFP-negative cell fractions (data not shown).

1.3 Enrichment of Genome-Edited THP-1 Cells by FACS Following Co-Transduction of CRIPSR/Cpf1-NLS and GFP-NLS The experiments performed in Examples 1.1 and 1.2 were reproduced in THP-1 cells with similar results. Co-transduction of CRIPSR/Cpf1-NLS and GFP-NLS in the presence 2 µM FSD18, followed by fluorescence-activated cell sorting of GFP-positive cells resulted in a significant enrichment of genome edited cells (data not shown).

1.4 Successful Subsequent Transduction of Previously Sorted GFP-Negative Cells

This example shows that untransduced cells following a first round of transduction with a peptide shuttle agent are not necessarily refractory to subsequent transductions.

T cells obtained as described in Example 1.1 were subjected to a first transduction by co-incubation of FSD18 (10 µM) and GFP-NLS (20 µM) for 90 sec before washing and incubation at 37° C. The "untreated" negative control cells showed no GFP signal (FIG. 60A). Cell sorting was performed 18 h after GFP-NLS transduction. GFP-positive and GFP-negative cells were separated using cell sorters based on the fluorescence signal (see FIG. 60B), and GFP-negative cells were harvested and isolated (see FIG. 60C). A second GFP-NLS transduction was performed on the GFP-negative T cell population using the same protocol as the first transduction. GFP-NLS transduction was analyzed by flow cytometry as previously described 18 h later and GFP-positive cells were scored by flow cytometry. The results from this second transduction are shown in FIG. 60D, in which the GFP-NLS transduction efficiency was found to be 60.6%. These results indicate that untransduced cells following a first round of transduction with a peptide shuttle agent are not necessarily refractory to subsequent transductions, and that overall transduction efficiency in a starting cell population may be increased by repeated successive transduction experiments on the untransduced cell fraction. This method of repeated successive transduction experiments, along with the co-transduction results presented in Examples 1.1, 1.2 and 1.3, suggest an attractive method for increasing genome editing efficiency in valuable cell populations (e.g., patient-derived cells for cell therapy), and/or in cell populations that are inherently more difficult to transduce.

REFERENCES

Andreu, D., Ubach, J., Boman, A., Wahlin, B., Wade, D., Merrifield, R. B., and Boman, H. G. (1992) Shortened cecropin A-melittin hybrids. Significant size reduction retains potent antibiotic activity. FEBS letters 296, 190-194

Aguila, J. R., W. Liao, J. Yang, C. Avila, N. Hagag, L. Senzel and Y. Ma (2011). "SALL4 is a robust stimulator for the expansion of hematopoietic stem cells." Blood 118(3): 576-585.

Akinci, E., A. Banga, L. V. Greder, J. R. Dutton and J. M. Slack (2012). "Reprogramming of pancreatic exocrine cells towards a beta (beta) cell character using Pdx1, Ngn3 and MafA." Biochem J 442(3): 539-550.

Alford et al., (2009). "Toxicity of organic fluorophores used in molecular imaging: literature review." Mol Imaging. 8(6):341-54.

Amand, H. L., B. Norden and K. Fant (2012). "Functionalization with C-terminal cysteine enhances transfection efficiency of cell-penetrating peptides through dimer formation." Biochem Biophys Res Commun 418(3): 469-474.

Aoukaty, A. & Tan, R. (2005). Role for glycogen synthase kinase-3 in NK cell cytotoxicity and X-linked lymphoproliferative disease. J Immunol 174, 4551-8.

Barrangou, R. and Luciano A. Marraffini (2014). "CRISPR-Cas Systems: Prokaryotes Upgrade to Adaptive Immunity". Cell Volume 54, Issue 2, p234-244, 24 Apr. 2014.

Bejarano, L. A. and C. Gonzalez (1999). "Motif trap: a rapid method to clone motifs that can target proteins to defined subcellular localisations." J Cell Sci 112 (Pt 23): 4207-4211.

Bikard et al., Programmable repression and activation of bacterial gene expression using an engineered CRISPR-Cas system. Nucleic Acids Res. 41, 7429-7437.

Boman, H. G., Wade, D., Boman, I. A., Wahlin, B., and Merrifield, R. B. (1989) Antibacterial and antimalarial properties of peptides that are cecropin-melittin hybrids. FEBS letters 259,103-106.

Braud, V. M., Allan, D. S., O'Callaghan, C. A., Soderstrom, K., D'Andrea, A., Ogg, G. S., Lazetic, S., Young, N. T., Bell, J. I., Phillips, J. H., Lanier, L. L. & McMichael, A. J. (1998). HLA-E binds to natural killer cell receptors CD94/NKG2A, B and C. Nature 391, 795-9.

Buganim et al., (2014) "The Developmental Potential of iPSCs Is Greatly Influenced by Reprogramming Factor Selection". Cell stem cell. 15, 295-309.

Burstein et al., (2017), "New CRISPR-Cas systems from uncultivated microbes." Nature. 542(7640):237-241.

Chan, C. K. and D. A. Jans (1999). "Enhancement of polylysine-mediated transferrinfection by nuclear localization sequences: polylysine does not function as a nuclear localization sequence." Hum Gene Ther 10(10): 1695-1702.

Chan, C. K. and D. A. Jans (2001). "Enhancement of MSH receptor- and GAL4-mediated gene transfer by switching the nuclear import pathway." Gene Ther 8(2): 166-171.

Cong et al., (2013). Multiplex genome engineering using CRISPR/Cas systems. Science 339, 819-823.

Cooper, M. A., Fehniger, T. A. & Caligiuri, M. A. (2001). The biology of human natural killer-cell subsets. Trends Immunol 22, 633-40.

Cox et al. (2015). "Therapeutic genome editing: prospects and challenges". Nature medicine, 21:121-131.

de Kruijf, E. M., Sajet, A., van Nes, J. G., Natanov, R., Putter, H., Smit, V. T., Liefers, G. J., van den Eisen, P. J., van de Velde, C. J. & Kuppen, P. J. (2010). HLA-E and HLA-G expression in classical HLA class I-negative tumors is of prognostic value for clinical outcome of early breast cancer patients. J Immunol 185, 7452-9.

Delconte, R. B., Kolesnik, T. B., Dagley, L. F., Rautela, J., Shi, W., Putz, E. M., Stannard, K., Zhang, J. G., Teh, C., Firth, M., Ushiki, T., Andoniou, C. E., Degli-Esposti, M. A., Sharp, P. P., Sanvitale, C. E., Infusini, G., Liau, N. P., Linossi, E. M., Burns, C. J., Carotta, S., Gray, D. H., Seillet, C., Hutchinson, D. S., Belz, G. T., Webb, A. I., Alexander, W. S., Li, S. S., Bullock, A. N., Babon, J. J., Smyth, M. J., Nicholson, S. E. & Huntington, N. D. (2016). CIS is a potent checkpoint in NK cell-mediated tumor immunity. Nat Immunol 17, 816-24.

Denman, C. J., Senyukov, V. V., Somanchi, S. S., Phatarpekar, P. V., Kopp, L. M., Johnson, J. L., Singh, H., Hurton, L., Maiti, S. N., Huls, M. H., Champlin, R. E., Cooper, L. J. & Lee, D. A. (2012). Membrane-bound IL-21 promotes sustained ex vivo proliferation of human natural killer cells. PLoS ONE 7, e30264.

Dolfini, D., M. Minuzzo, G. Pavesi and R. Mantovani (2012). "The short isoform of NF-YA belongs to the embryonic stem cell transcription factor circuitry." Stem Cells 30(11): 2450-2459.

Drin, G., S. Cottin, E. Blanc, A. R. Rees and J. Temsamani (2003). "Studies on the internalization mechanism of cationic cell-penetrating peptides." J Biol Chem 278(33): 31192-31201.

Eisenberg et al., (1982). "The helical hydrophobic moment: a measure of the amphiphilicity of a helix". Nature 299, 371-374.

EI-Andaloussi, S., H. J. Johansson, T. Holm and U. Langel (2007). "A novel cell-penetrating peptide, M918, for efficient delivery of proteins and peptide nucleic acids." Mol Ther 15(10): 1820-1826.

EI-Sayed, A., S. Futaki and H. Harashima (2009). "Delivery of macromolecules using arginine-rich cell-penetrating peptides: ways to overcome endosomal entrapment." AAPS J 11(1): 13-22.

Elmquist, A., M. Lindgren, T. Bartfai and U. Langel (2001). "VE-cadherin-derived cell-penetrating peptide, pVEC, with carrier functions." Exp Cell Res 269(2): 237-244.

Erazo-Oliveras et al., (2014) "Protein delivery into live cells by incubation with an endosomolytic agent." Nat Methods. (8):861-7.

Fanara, P., M. R. Hodel, A. H. Corbett and A. E. Hodel (2000). "Quantitative analysis of nuclear localization signal (NLS)-importin alpha interaction through fluorescence depolarization. Evidence for auto-inhibitory regulation of NLS binding." J Biol Chem 275(28): 21218-21223.

Fasoli A et al., (2014) "Mechanistic insight into CM18-Tat11 peptide membrane-perturbing action by whole-cell patch-clamp recording." Molecules. 19(7):9228-39.

Fawell, S., J. Seery, Y. Daikh, C. Moore, L. L. Chen, B. Pepinsky and J. Barsoum (1994). "Tat-mediated delivery of heterologous proteins into cells." Proc Natl Acad Sci USA 91(2): 664-668.

Fominaya, J., C. Uherek and W. Wels (1998). "A chimeric fusion protein containing transforming growth factor-alpha mediates gene transfer via binding to the EGF receptor." Gene Ther 5(4): 521-530.

Fominaya, J. and W. Wels (1996). "Target cell-specific DNA transfer mediated by a chimeric multidomain protein. Novel non-viral gene delivery system." J Biol Chem 271(18): 10560-10568.

Fonoudi, H., M. Yeganeh, F. Fattahi, Z. Ghazizadeh, H. Rassouli, M. Alikhani, B. A. Mojarad, H. Baharvand, G. H. Salekdeh and N. Aghdami (2013). "ISL1 protein transduction promotes cardiomyocyte differentiation from human embryonic stem cells." PLoS One 8(1): e55577.

Gao et al., (2016) DNA-guided genome editing using the Natronobacterium gregoryi Argonaute. Nature Biotechnology 34, 768-773.

Giguere et al., Machine learning assisted design of highly active peptides for drug discovery. PLoS Comput Biol. 2015 Apr. 7; 11(4):e1004074.

Gilbert et al., CRISPR-mediated modular RNA-guided regulation of transcription in eukaryotes. Cell 154, 442-451.

Gilmore, T. D. and H. M. Temin (1988). "v-rel oncoproteins in the nucleus and in the cytoplasm transform chicken spleen cells." J Virol 62(3): 703-714.

Glover, D. J., S. M. Ng, A. Mechler, L. L. Martin and D. A. Jans (2009). "Multifunctional protein nanocarriers for targeted nuclear gene delivery in nondividing cells." FASEB J 23(9): 2996-3006.

Gordon, S. M., J. Chaix, L. J. Rupp, J. Wu, S. Madera, J. C. Sun, T. Lindsten and S. L. Reiner (2012). "The transcription factors T-bet and Eomes control key checkpoints of natural killer cell maturation." Immunity 36(1): 55-67.

Gottschalk, S., J. T. Sparrow, J. Hauer, M. P. Mims, F. E. Leland, S. L. Woo and L. C. Smith (1996). "A novel DNA-peptide complex for efficient gene transfer and expression in mammalian cells." Gene Ther 3(5): 448-457.

Gould, S. J., G. A. Keller, N. Hosken, J. Wilkinson and S. Subramani (1989). "A conserved tripeptide sorts proteins to peroxisomes." J Cell Biol 108(5): 1657-1664.

Green, M. and P. M. Loewenstein (1988). "Autonomous functional domains of chemically synthesized human immunodeficiency virus tat trans-activator protein." Cell 55(6): 1179-1188.

Grimes, M. L., J. Zhou, E. C. Beattie, E. C. Yuen, D. E. Hall, J. S. Valletta, K. S. Topp, J. H. LaVail, N. W. Bunnett and W. C. Mobley (1996). "Endocytosis of activated TrkA: evidence that nerve growth factor induces formation of signaling endosomes." J Neurosci 16(24): 7950-7964.

Guo, Z. Y., Lv, Y. G., Wang, L., Shi, S. J., Yang, F., Zheng, G. X., Wen, W. H. & Yang, A. G. (2015). Predictive value of HLA-G and HLA-E in the prognosis of colorectal cancer patients. Cell Immunol 293,10-6.

Hallbrink, M., A. Floren, A. Elmquist, M. Pooga, T. Bartfai and U. Langel (2001). "Cargo delivery kinetics of cell-penetrating peptides." Biochim Biophys Acta 1515(2): 101-109.

Herce, H. D. and A. E. Garcia (2007). "Molecular dynamics simulations suggest a mechanism for translocation of the HIV-1 TAT peptide across lipid membranes." Proc Nat Acad Sci USA 104(52): 20805-20810.

Ho et al., (2001). "Synthetic protein transduction domains: enhanced transduction potential in vivo." Cancer Research 61: 474-477.

Homg, T., Bezbradica, J. S. & Medzhitov, R. (2007). NKG2D signaling is coupled to the interleukin 15 receptor signaling pathway. Nat Immunol 8,1345-52.

Hurt, E. C., B. Pesold-Hurt, K. Suda, W. Oppliger and G. Schatz (1985). "The first twelve amino acids (less than half of the pre-sequence) of an imported mitochondrial protein can direct mouse cytosolic dihydrofolate reductase into the yeast mitochondrial matrix." EMBO J 4(8): 2061-2068.

Ichii, H., A. Sakamoto, Y. Kuroda and T. Tokuhisa (2004). "Bcl6 acts as an amplifier for the generation and proliferative capacity of central memory CD8+ T cells." J Immunol 173(2): 883-891.

Irie, Y., K. Yamagata, Y. Gan, K. Miyamoto, E. Do, C. H. Kuo, E. Taira and N. Miki (2000). "Molecular cloning and characterization of Amida, a novel protein which interacts with a neuron-specific immediate early gene product arc, contains novel nuclear localization signals, and causes cell death in cultured cells." J Biol Chem 275(4): 2647-2653.

Ishigami, S., Arigami, T., Okumura, H., Uchikado, Y., Kita, Y., Kurahara, H., Maemura, K., Kijima, Y., Ishihara, Y., Sasaki, K., Uenosono, Y. & Natsugoe, S. (2015). Human leukocyte antigen (HLA)-E and HLA-F expression in gastric cancer. Anticancer Res 35, 2279-85.

Kakudo, T., S. Chaki, S. Futaki, I. Nakase, K. Akaji, T. Kawakami, K. Maruyama, H. Kamiya and H. Harashima (2004). "Transferrin-modified liposomes equipped with a pH-sensitive fusogenic peptide: an artificial viral-like delivery system." Biochemistry 43(19): 5618-5628.

Kamiely, S. and O. Pines (2005). "Single translation—dual destination: mechanisms of dual protein targeting in eukaryotes." EMBO Rep 6(5): 420-425.

Kato, G. J., W. M. Lee, L. L. Chen and C. V. Dang (1992). "Max: functional domains and interaction with c-Myc." Genes Dev 6(1): 81-92.

Kichler, A., A. J. Mason and B. Bechinger (2006). "Cationic amphipathic histidine-rich peptides for gene delivery." Biochim Biophys Acta 1758(3): 301-307.

Kichler et al., (2003). "Histidine-rich amphipathic peptide antibiotics promote efficient delivery of DNA into mammalian cells". Proc Natl Acad Sci USA. 2003 Feb. 18; 100(4): 1564-1568.

Kira et al., (2011). "Unification of Cas protein families and a simple scenario for the origin and evolution of CRISPR-Cas systems". Biol Direct. 2011; 6: 38.

Kirwan, S. E. & Burshtyn, D. N. (2005). Killer cell Ig-like receptor-dependent signaling by Ig-like transcript 2 (ILT2/CD85j/LILRB1/LIR-1). J Immunol 175, 5006-15.

Kleinschmidt, J. A. and A. Seiter (1988). "Identification of domains involved in nuclear uptake and histone binding of protein N1 of Xenopus laevis." EMBO J 7(6): 1605-1614.

Kohler, M., D. Gorlich, E. Hartmann and J. Franke (2001). "Adenoviral E1A protein nuclear import is preferentially mediated by importin alpha3 in vitro." Virology 289(2): 186-191.

Kwon, et al., (2010). "A Truncated HGP Peptide Sequence That Retains Endosomolytic Activity and Improves Gene Delivery Efficiencies". Mol. Pharmaceutics, 7:1260-65.

Lamiable et al., (2016). "PEP-FOLD3: faster de novo structure prediction for linear peptides in solution and in complex" Nucleic Acids Res. 44(W1):W449-54.

Lanford, R. E., P. Kanda and R. C. Kennedy (1986). "Induction of nuclear transport with a synthetic peptide homologous to the SV40 T antigen transport signal." Cell 46(4): 575-582.

Lee, N., Llano, M., Carretero, M., Ishitani, A., Navarro, F., Lopez-Botet, M. & Geraghty, D. E. (1998). HLA-E is a major ligand for the natural killer inhibitory receptor CD94/NKG2A. Proc Natl Acad Sci USA 95, 5199-204.

Levy, E. M., Bianchini, M., Von Euw, E. M., Barrio, M. M., Bravo, A. I., Furman, D., Domenichini, E., Macagno, C., Pinsky, V., Zucchini, C., Valvassori, L. & Mordoh, J. (2008). Human leukocyte antigen-E protein is overexpressed in primary human colorectal cancer. Int J Oncol 32, 633-41.

Li, W., F. Nicol and F. C. Szoka, Jr. (2004). "GALA: a designed synthetic pH-responsive amphipathic peptide with applications in drug and gene delivery." Adv Drug Deliv Rev 56(7): 967-985.

Lin, M. H., F. C. Chou, L. T. Yeh, S. H. Fu, H. Y. Chiou, K. I. Lin, D. M. Chang and H. K. Sytwu (2013). "B lymphocyte-induced maturation protein 1 (BLIMP-1) attenuates autoimmune diabetes in NOD mice by suppressing Th1 and Th17 cells." Diabetologia 56(1): 136-146.

Liu, X., P. K. Tian, D. W. Ju, M. H. Zhang, M. Yao, X. T. Cao and J. R. Gu (2003). "Systemic genetic transfer of p21WAF-1 and GM-CSF utilizing of a novel oligopeptide-based EGF receptor targeting polyplex." Cancer Gene Ther 10(7): 529-539.

Loeser, S., Loser, K., Bijker, M. S., Rangachari, M., van der Burg, S. H., Wada, T., Beissert, S., Melief, C. J. & Penninger, J. M. (2007). Spontaneous tumor rejection by cbl-b-deficient CD8+ T cells. J Exp Med 204, 879-91.

London, E. (1992). "Diphtheria toxin: membrane interaction and membrane translocation." Biochim Biophys Acta 1113(1): 25-51.

Lord-Dufour et al., (2009) "Evidence for transcriptional regulation of the glucose-6-phosphate transporter by HIF-1alpha: Targeting G6PT with mumbaistatin analogs in hypoxic mesenchymal stromal cells". Stem cells 27:489-497.

Lorieau, J. L., J. M. Louis and A. Bax (2010). "The complete influenza hemagglutinin fusion domain adopts a tight helical hairpin arrangement at the lipid:water interface." Proc Natl Acad Sci USA 107(25): 11341-11346.

Lin, A., Yan, W. H., Xu, H. H., Gan, M. F., Cai, J. F., Zhu, M. & Zhou, M. Y. (2007). HLA-G expression in human ovarian carcinoma counteracts NK cell function. Ann Oncol 18,1804-9.

Liu, Q., Zhou, H., Langdon, W. Y. & Zhang, J. (2014). E3 ubiquitin ligase Cbl-b in innate and adaptive immunity. Cell Cycle 13,1875-84.

Lu, S. J., Q. Feng, Y. lvanova, C. Luo, T. Li, F. Li, G. R. Honig and R. Lanza (2007). "Recombinant HoxB4 fusion proteins enhance hematopoietic differentiation of human embryonic stem cells." Stem Cells Dev 16(4): 547-559.

Luan et al., (2015). "Peptide amphiphiles with multifunctional fragments promoting cellular uptake and endosomal escape as efficient gene vectors." J. Mater. Chem. B, 3:1068-1078.

Lutz-Nicoladoni, C., Wolf, D. & Sopper, S. (2015). Modulation of Immune Cell Functions by the E3 Ligase Cbl-b. Front Oncol 5, 58.

Mack, M., B. Luckow, P. J. Nelson, J. Cihak, G. Simmons, P. R. Clapham, N. Signoret, M. Marsh, M. Stangassinger, F. Borlat, T. N. Wells, D. Schlondorff and A. E. Proudfoot (1998). "Aminooxypentane-RANTES induces CCR5 internalization but inhibits recycling: a novel inhibitory mechanism of HN infectivity." J Exp Med 187(8): 1215-1224.

Maeng, C. H., J. H. Yi, J. Lee, J. Y. Hong, M. K. Choi, H. A. Jung, J. O. Park, S. H. Park, Y. S. Park, W. K. Kang and H. Y. Lim (2013). "Effects of single nucleotide polymorphisms on treatment outcomes and toxicity in patients treated with sunitinib." Anticancer Res 33(10): 4619-4626.

Mahlum, E., D. Mandal, C. Halder, A. Maran, M. J. Yaszemski, R. B. Jenkins, M. E. Bolander and G. Sarkar (2007). "Engineering a noncarrier to a highly efficient carrier peptide for noncovalently delivering biologically active proteins into human cells." Anal Biochem 365(2): 215-221.

Makarova et al., (2011) "Evolution and classification of the CRISPR-Cas systems". Nat Rev Microbiol. 9(6):467-77.

Makkerh, J. P., C. Dingwall and R. A. Laskey (1996). "Comparative mutagenesis of nuclear localization signals reveals the importance of neutral and acidic amino acids." Curr Biol 6(8): 1025-1027.

Martinez-Fong, D., I. Navarro-Quiroga, I. Ochoa, I. Alvarez-Maya, M. A. Meraz, J. Luna and J. A. Arias-Montano (1999). "Neurotensin-SPDP-poly-L-lysine conjugate: a nonviral vector for targeted gene delivery to neural cells." Brain Res Mol Brain Res 69(2): 249-262.

Matalon, O., Fried, S., Ben-Shmuel, A., Pauker, M. H., Joseph, N., Keizer, D., Piterburg, M. & Barda-Saad, M. (2016). Dephosphorylation of the adaptor LAT and phospholipase C-gamma by SHP-1 inhibits natural killer cell cytotoxicity. Sci Signal 9, raS4.

Maurer, M. and E. von Stebut (2004). "Macrophage inflammatory protein-1." Int J Biochem Cell Biol 36(10): 1882-1886.

McKay, T., P. Reynolds, S. Jezzard, D. Curiel and C. Coutelle (2002). "Secretin-mediated gene delivery, a specific targeting mechanism with potential for treatment of biliary and pancreatic disease in cystic fibrosis." Mol Ther 5(4): 447-454.

Midoux, P., A. Kichler, V. Boutin, J. C. Maurizot and M. Monsigny (1998). "Membrane permeabilization and efficient gene transfer by a peptide containing several histidines." Bioconjug Chem 9(2): 260-267.

Milenkovic, D., T. Ramming, J. M. Muller, L. S. Wenz, N. Gebert, A. Schulze-Specking, D. Stojanovski, S. Rospert and A. Chacinska (2009). "Identification of the signal directing Tim9 and Tim10 into the intermembrane space of mitochondria." Mol Biol Cell 20(10): 2530-2539.

Miyoshi, I., N. Kasai and Y. Hayashizaki (1994). "[Structure and regulation of human thyroid-stimulating hormone (TSH) gene]." Nihon Rinsho 52(4): 940-947.

Moede, T., B. Leibiger, H. G. Pour, P. Berggren and I. B. Leibiger (1999). "Identification of a nuclear localization signal, RRMKWKK, in the homeodomain transcription factor PDX-1." FEBS Lett 461(3): 229-234.

Montrose, K., Y. Yang, X. Sun, S. Wiles and G. W. Krissansen (2013). "Xentry, a new class of cell-penetrating peptide uniquely equipped for delivery of drugs." Sci Rep 3:1661.

Moreland, R. B., G. L. Langevin, R. H. Singer, R. L. Garcea and L. M. Hereford (1987). "Amino acid sequences that determine the nuclear localization of yeast histone 2B." Mol Cell Biol 7(11): 4048-4057.

Morris, M. C., L. Chaloin, M. Choob, J. Archdeacon, F. Heitz and G. Divita (2004). "Combination of a new generation of PNAs with a peptide-based carrier enables efficient targeting of cell cycle progression." Gene Ther 11(9): 757-764.

Morris, M. C., J. Depollier, J. Mery, F. Heitz and G. Divita (2001). "A peptide carrier for the delivery of biologically active proteins into mammalian cells." Nat Biotechnol 19(12): 1173-1176.

Nakanishi, A., D. Shum, H. Morioka, E. Otsuka and H. Kasamatsu (2002). "Interaction of the Vp3 nuclear localization signal with the importin alpha 2/beta heterodimer directs nuclear entry of infecting simian virus 40." J Virol 76(18): 9368-9377.

O'Keefe, D. O. (1992). "Characterization of a full-length, active-site mutant of diphtheria toxin." Arch Biochem Biophys 296(2): 678-684.

Paolino, M., Choidas, A., Wallner, S., Pranjic, B., Uribesalgo, I., Loeser, S., Jamieson, A. M., Langdon, W. Y., Ikeda, F., Fededa, J. P., Cronin, S. J., Nitsch, R., Schultz-Fademrecht, C., Eickhoff, J., Menninger, S., Unger, A., Torka, R., Gruber, T., Hinterleitner, R., Baier, G., Wolf, D., Ullrich, A., Klebl, B. M. & Penninger, J. M. (2014). The E3 ligase Cbl-b and TAM receptors regulate cancer metastasis via natural killer cells. Nature 507, 508-12.

Parente, R. A., S. Nir and F. C. Szoka, Jr. (1990). "Mechanism of leakage of phospholipid vesicle contents induced by the peptide GALA." Biochemistry 29(37): 8720-8728.

Parameswaran, R., Ramakrishnan, P., Moreton, S. A., Xia, Z., Hou, Y., Lee, D. A., Gupta, K., deLima, M., Beck, R. C. & Wald, D. N. (2016). Repression of GSK3 restores NK cell cytotoxicity in AML patients. Nat Commun 7, 11154.

Patel, P. & Woodgett, J. R. (2017). Glycogen Synthase Kinase 3: A Kinase for All Pathways?Curr Top Dev Biol 123, 277-302.

Paul, R. W., K. E. Weisser, A. Loomis, D. L. Sloane, D. LaFoe, E. M. Atkinson and R. W. Overell (1997). "Gene transfer using a novel fusion protein, GAL4/invasin." Hum Gene Ther 8(10): 1253-1262.

Perez, F., A. Joliot, E. Bloch-Gallego, A. Zahraoui, A. Triller and A. Prochiantz (1992). "Antennapedia homeobox as a signal for the cellular internalization and nuclear addressing of a small exogenous peptide." J Cell Sci 102 (Pt 4): 717-722.

Pimenta, D. C., V. C. Chen, J. Chao, M. A. Juliano and L. Juliano (2000). "Alpha1-antichymotrypsin and kallistatin hydrolysis by human cathepsin D." J Protein Chem 19(5): 411-418.

Poli, A., Michel, T., Theresine, M., Andres, E., Hentges, F. & Zimmer, J. (2009). CD56bright natural killer (NK) cells: an important NK cell subset. Immunology 126, 458-65.

Prieve, M. G. and M. L. Waterman (1999). "Nuclear localization and formation of beta-catenin-lymphoid enhancer factor 1 complexes are not sufficient for activation of gene expression." Mol Cell Biol 19(6): 4503-4515.

Rajagopalan, R., J. Xavier, N. Rangaraj, N. M. Rao and V. Gopal (2007). "Recombinant fusion proteins TAT-Mu, Mu and Mu-Mu mediate efficient non-viral gene delivery." J Gene Med 9(4): 275-286.

Riddell et al., (2014) "Reprogramming committed murine blood cells to induced hematopoietic stem cells with defined factors". Cell, 157:549-564

Salomone, F., F. Cardarelli, M. Di Luca, C. Boccardi, R. Nifosi, G. Bardi, L. Di Bari, M. Serresi and F. Beltram (2012). "A novel chimeric cell-penetrating peptide with membrane-disruptive properties for efficient endosomal escape." J Control Release 163(3): 293-303.

Salomone F., Cardarelli F, Signore G, Boccardi C, Beltram F. (2013) "In vitro efficient transfection by $CM_{18}$-$Tat_{11}$ hybrid peptide: a new tool for gene-delivery applications." PLoS One. 8(7):e70108.

Schneider, H., R. P. Harbottle, Y. Yokosaki, J. Kunde, D. Sheppard and C. Coutelle (1998). "A novel peptide, PLAEIDGIELTY, for the targeting of alpha9beta1-integrins." FEBS Lett 429(3): 269-273.

Schreiber, V., M. Molinete, H. Boeuf, G. de Murcia and J. Menissier-de Murcia (1992). "The human poly(ADP-ribose) polymerase nuclear localization signal is a bipartite element functionally separate from DNA binding and catalytic activity." EMBO J 11(9): 3263-3269.

Schuster, M. J., G. Y. Wu, C. M. Walton and C. H. Wu (1999). "Multicomponent DNA carrier with a vesicular stomatitis virus G-peptide greatly enhances liver-targeted gene expression in mice." Bioconjug Chem 10(6): 1075-1083.

Scott, M. S., F. M. Boisvert, M. D. McDowall, A. I. Lamond and G. J. Barton (2010). "Characterization and prediction of protein nucleolar localization sequences." Nucleic Acids Res 38(21): 7388-7399.

Shaw, P. A., I. R. Catchpole, C. A. Goddard and W. H. Colledge (2008). "Comparison of protein transduction domains in mediating cell delivery of a secreted CRE protein." Biochemistry 47(4): 1157-1166.

Shawe-Taylor J, Cristianini N (2004) Kemel methods for pattern analysis. Cambridge university press.

Shen et al., (2014) "Improved PEP-FOLD approach for peptide and miniprotein structure prediction". J. Chem. Theor. Comput. 10:4745-4758.

Shoya, Y., T. Kobayashi, T. Koda, K. Ikuta, M. Kakinuma and M. Kishi (1998). "Two proline-rich nuclear localization signals in the amino- and carboxyl-terminal regions of the Borna disease virus phosphoprotein." J Virol 72(12): 9755-9762.

Somasekaram, A., A. Jarmuz, A. How, J. Scott and N. Navaratnam (1999). "Intracellular localization of human cytidine deaminase. Identification of a functional nuclear localization signal." J Biol Chem 274(40): 28405-28412.

Stojanovski, D., M. Bohnert, N. Pfanner and M. van der Laan (2012). "Mechanisms of protein sorting in mitochondria." Cold Spring Harb Perspect Biol 4(10).

Sudbeck, P. and G. Scherer (1997). "Two independent nuclear localization signals are present in the DNA-binding high-mobility group domains of SRY and SOX9." J Biol Chem 272(44): 27848-27852.

Sung, M. S., J. Y. Mun, O. Kwon, K. S. Kwon and D. B. Oh (2013). "Efficient myogenic differentiation of human adipose-derived stem cells by the transduction of engineered MyoD protein." Biochem Biophys Res Commun 437(1): 156-161.

Takahashi, K. and S. Yamanaka (2006). "Induction of pluripotent stem cells from mouse embryonic and adult fibroblast cultures by defined factors." Cell 126(4): 663-676.

Takeda, A., C. Goolsby and N. R. Yaseen (2006). "NUP98-HOXA9 induces long-term proliferation and blocks differentiation of primary human CD34+hematopoietic cells." Cancer Res 66(13): 6628-6637.

Tan, Y., Z. Xie, M. Ding, Z. Wang, Q. Yu, L. Meng, H. Zhu, X. Huang, L. Yu, X. Meng and Y. Chen (2010). "Increased levels of FoxA1 transcription factor in pluripotent P19 embryonal carcinoma cells stimulate neural differentiation." Stem Cells Dev 19(9): 1365-1374.

Tan, Y. X., C. Chen, Y. L. Wang, S. Lin, Y. Wang, S. B. Li, X. P. Jin, H. W. Gao, F. S. Du, F. Gong and S. P. Ji (2012). "Truncated peptides from melittin and its analog with high lytic activity at endosomal pH enhance branched polyethylenimine-mediated gene transfection." J Gene Med 14(4): 241-250.

Thevenet et al., "PEP-FOLD: an updated de novo structure prediction server for both linear and disulfide bonded cyclic peptides." Nucleic Acids Res. 2012. 40, W288-293.

Uherek, C., J. Fominaya and W. Wels (1998). "A modular DNA carrier protein based on the structure of diphtheria toxin mediates target cell-specific gene delivery." J Biol Chem 273(15): 8835-8841.

Varkouhi, A. K., M. Scholte, G. Storm and H. J. Haisma (2011). "Endosomal escape pathways for delivery of biologicals." J Control Release 151(3): 220-228.

Veach, R. A., D. Liu, S. Yao, Y. Chen, X. Y. Liu, S. Downs and J. Hawiger (2004). "Receptor/transporter-independent targeting of functional peptides across the plasma membrane." J Biol Chem 279(12): 11425-11431.

Vives, E., P. Brodin and B. Lebleu (1997). "A truncated HIV-1 Tat protein basic domain rapidly translocates through the plasma membrane and accumulates in the cell nucleus." J Biol Chem 272(25): 16010-16017.

Wagstaff, K. M., D. J. Glover, D. J. Tremethick and D. A. Jans (2007). "Histone-mediated transduction as an efficient means for gene delivery." Mol Ther 15(4): 721-731.

Warr, M. R., M. Binnewies, J. Flach, D. Reynaud, T. Garg, R. Malhotra, J. Debnath and E. Passegue (2013). "FOX03A directs a protective autophagy program in haematopoietic stem cells." Nature 494(7437): 323-327.

Welch, K., J. Franke, M. Kohler and I. G. Macara (1999). "RanBP3 contains an unusual nuclear localization signal that is imported preferentially by importin-alpha3." Mol Cell Biol 19(12): 8400-8411.

Wiedenheft et al., (2011). RNA-guided complex from a bacterial immune system enhances target recognition through seed sequence interactions. Proc. Natl. Acad. Sci. USA 108,10092-10097.

Witzel, I., M. Graeser, T. Karn, M. Schmidt, R. Wirtz, D. Schutze, A. Rausch, F. Janicke, K. Milde-Langosch and V. Muller (2013). "Androgen receptor expression is a predictive marker in chemotherapy-treated patients with endocrine receptor-positive primary breast cancers." J Cancer Res Clin Oncol 139(5): 809-816.

Wu, J., L. Zhou, K. Tonissen, R. Tee and K. Artzt (1999). "The quaking I-5 protein (QKI-5) has a novel nuclear localization signal and shuttles between the nucleus and the cytoplasm." J Biol Chem 274(41): 29202-29210.

Wu, D., Kuiaste, I., Moreau, P., Carosella, E. & Yotnda, P. (2015). Rescuing lymphocytes from HLA-G immunosuppressive effects mediated by the tumor microenvironment. Oncotarget 6, 37385-97.

Wyman, T. B., F. Nicol, 0. Zelphati, P. V. Scaria, C. Plank and F. C. Szoka, Jr. (1997). "Design, synthesis, and characterization of a cationic peptide that binds to nucleic acids and permeabilizes bilayers." Biochemistry 36(10): 3008-3017.

Ye, S. R., Yang, H., Li, K., Dong, D. D., Lin, X. M. & Yie, S. M. (2007a). Human leukocyte antigen G expression: as a significant prognostic indicator for patients with colorectal cancer. Mod Pathol 20, 375-83.

Yie, S. M., Yang, H., Ye, S. R., Li, K., Dong, D. D. & Lin, X. M. (2007b). Expression of human leukocyte antigen G (HLA-G) correlates with poor prognosis in gastric carcinoma. Ann Surg Oncol 14, 2721-9.

Yie, S. M., Yang, H., Ye, S. R., Li, K., Dong, D. D. & Lin, X. M. (2007c). Expression of human leucocyte antigen G (HLA-G) is associated with prognosis in non-small cell lung cancer. Lung Cancer 58, 267-74.

Yie, S. M., Yang, H., Ye, S. R., Li, K., Dong, D. D. & Lin, X. M. (2007d). Expression of HLA-G is associated with prognosis in esophageal squamous cell carcinoma. Am J Clin Pathol 128,1002-9.

Yu, Z., C. H. Lee, C. Chinpaisal and L. N. Wei (1998). "A constitutive nuclear localization signal from the second zinc-finger of orphan nuclear receptor TR2." J Endocrinol 159(1): 53-60.

Zetsche et al., (2015). "Cpf1 Is a Single RNA-Guided Endonuclease of a Class 2 CRISPR-Cas System". Cell. 25. pii: S0092-8674(15)01200-3 [http://dx.doi.org/10.1016/j.cell.2015.09.038].

Zhen, Z. J., Ling, J. Y., Cai, Y., Luo, W. B. & He, Y. J. (2013). Impact of HLA-E gene polymorphism on HLA-E expression in tumor cells and prognosis in patients with stage Ill colorectal cancer. Med Oncol 30, 482.

Zhou, H., S. Wu, J. Y. Joo, S. Zhu, D. W. Han, T. Lin, S. Trauger, G. Bien, S. Yao, Y. Zhu, G. Siuzdak, H. R. Scholer, L. Duan and S. Ding (2009). "Generation of induced pluripotent stem cells using recombinant proteins." Cell Stem Cell 4(5): 381-384. The primary amino acid sequences of peptides FSD5, FSD16, FSD18, FSD19, FSD20, FSD22, and FSD23 are related, as shown in the alignment below.

Example C

Computer-Assisted Design of Synthetic Peptide Shuttle Agents

C.1 Machine-Learning-Assisted Design Approach

The peptides listed in Table C1 were designed using an algorithm described in an article by S6bastien Gigubre et al. entitled "*Machine Learning Assisted Design of Highly Active Peptides for Drug Discovery*" (Gigu6re et al., 2014). This computational prediction method is founded on the use of algorithms based on the Kernel and machine learning methods (Shawe-Taylor J. and Cristianini N., 2004). These algorithms aim to sort peptides with maximal bioactivity depending on a biological effect of interest. Here, we considered all the peptides that we tested to date in protein transduction assays, and separated them into three distinct groups. The composition of the groups was based on a "transduction score" calculated as described in Example A. Group 1 was composed of peptides demonstrating efficient cell delivery with low toxicity; Group 2 was composed of peptides demonstrating efficient cell delivery but with elevated toxicity; and Group 3 was composed of peptides that did not demonstrate any significant polypeptide cargo transduction ability.

The scores of the peptides in each group were used as starting data points for the generation of further peptide variants. The algorithm was programmed to use the peptide sequences and the scores of the peptides of Group 1 as the positive references for the prediction of peptide variants with efficient transduction ability. The sequences and the scores of Groups 2 and 3 were included as negative controls in the algorithm to delineate the search field. The peptide variants generated by the algorithm were limited to those having a length of 35 amino acids. After running, the prediction method generated sixteen sequences (FSD27 to FSD42). After analyzing the sequences of these sixteen sequences with respect to the design parameters set forth in Table Al, only peptides FSD27, FSD34 and FSD40 satisfied all of the design parameters (see Table C2). The other peptide variants had one or more parameters outside those set forth in Table Al.

SEQUENCE LISTING (10244 sequences)

SEQ ID NO: 1 - protein, 18 aa, synthetic construct
KWKLFKKIGAVLKVLTTG

SEQ ID NO: 2 - protein, 189 aa, synthetic construct
VGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPG

SEQ ID NO: 3 - protein, 30 aa, synthetic construct
WEAALAEALAEALAEHLAEALAEALEALAA

SEQ ID NO: 4 - protein, 115 aa, synthetic construct
VLAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALT

SEQ ID NO: 5 - protein, 24 aa, synthetic construct
GLFEAIEGFIENGWEGMIDGWYGC

SEQ ID NO: 6 - protein, 26 aa, synthetic construct
KKALLALALHHLAHLALHLALALKKA

SEQ ID NO: 7 - protein, 24 aa, synthetic construct
LLGRRGWEVLKYWWNLLQYWSQEL

SEQ ID NO: 8 - protein, 23 aa, synthetic construct
GLFHAIAHFIHGGWHGLIHGWYG

SEQ ID NO: 9 - protein, 23 aa, synthetic construct
GLFGAIAGFIENGWEGMIDGWYG

SEQ ID NO: 10 - protein, 23 aa, synthetic construct
LIRLWSHLIHIWFQNRRLKWKKK

SEQ ID NO: 11 - protein, 25 aa, synthetic construct
KFTIVFPHNQKGNWKNVPSNYHYCP

SEQ ID NO: 12 - protein, 115 aa, synthetic construct
EGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANAD

SEQ ID NO: 13 - protein, 26 aa, synthetic construct
GIGAVLKVLTTGLPALISWIKRKRQQ

SEQ ID NO: 14 - protein, 30 aa, synthetic construct
WEAKLAKALAKALAKHLAKALAKALKACEA

SEQ ID NO: 15 - protein, 20 aa, synthetic construct
GLFEALLELLESLWELLLEA

SEQ ID NO: 16 - protein, 16 aa, synthetic construct
AAVALLPAVLLALLAP

SEQ ID NO: 17 - protein, 11 aa, synthetic construct
YGRKKRRQRRR

SEQ ID NO: 18 - protein, 16 aa, synthetic construct
RQIKIWFQNRRMKWKK

SEQ ID NO: 19 - protein, 18 aa, synthetic construct
LLIILRRRIRKQAHAHSK

SEQ ID NO: 20 - protein, 22 aa, synthetic construct
MVTVLFRRLRIRRACGPPRVRV

SEQ ID NO: 21 - protein, 21 aa, synthetic construct
KETWWETWWTEWSQPKKKRKV

SEQ ID NO: 22 - protein, 21 aa, synthetic construct
KETWFETWFTEWSQPKKKRKV

SEQ ID NO: 23 - protein, 7 aa, synthetic construct
LCLRPVG

SEQ ID NO: 24 - protein, 9 aa, synthetic construct
RRRRRRRRR

SEQ ID NO: 25 - protein, 26 aa, synthetic construct
WTLNSAGYLLGKINLKALAALAKKIL

SEQ ID NO: 26 - protein, 18 aa, synthetic construct
RGGRLSYSRRRFSTSTGR

SEQ ID NO: 27 - protein, 10 aa, synthetic construct
RRLSYSRRRF

SEQ ID NO: 28 - protein, 5 aa, synthetic construct
KRPRP

SEQ ID NO: 29 - protein, 7 aa, synthetic construct
PKKKRKV

SEQ ID NO: 30 - protein, 9 aa, synthetic construct
PAAKRVKLD

SEQ ID NO: 31 - protein, 22 aa, synthetic construct
SSDDEATADSQHAAPPKKKRKV

SEQ ID NO: 32 - protein, 5 aa, synthetic construct
KKKRK

SEQ ID NO: 33 - protein, 16 aa, synthetic construct
KRPAATKKAGQAKKKK

SEQ ID NO: 34 - protein, 10 aa, synthetic construct
DGKKRKRSRK

SEQ ID NO: 35 - protein, 24 aa, synthetic construct
VRKKRKTEEESPLKDKDAKKSKQE

SEQ ID NO: 36 - protein, 19 aa, synthetic construct
KRKGDEVDGVDECAKKSKK

SEQ ID NO: 37 - protein, 7 aa, synthetic construct
RRMKWKK

SEQ ID NO: 38 - protein, 7 aa, synthetic construct
RVHPYQR

SEQ ID NO: 39 - protein, 24 aa, synthetic construct
KRPACTLKPECVQQLLVCSQEAKK

SEQ ID NO: 40 - protein, 7 aa, synthetic construct
GKKRSKA

SEQ ID NO: 41 - protein, 6 aa, synthetic construct
KAKRQR

SEQ ID NO: 42 - protein, 5 aa, synthetic construct
RKRRR

SEQ ID NO: 43 - protein, 9 aa, synthetic construct
PPVKRERTS

SEQ ID NO: 44 - protein, 10 aa, synthetic construct
PYLNKRKGKP

SEQ ID NO: 45 - protein, 9 aa, synthetic construct
KKKKRKREK

SEQ ID NO: 46 - protein, 9 aa, synthetic construct
KKKRRSREK

SEQ ID NO: 47 - protein, 8 aa, synthetic construct
PRPRKIPR

SEQ ID NO: 48 - protein, 20 aa, synthetic construct
KDCVINKHHRNRCQYCRLQR

SEQ ID NO: 49 - protein, 5 aa, synthetic construct
PRRRK

SEQ ID NO: 50 - protein, 8 aa, synthetic construct
PQSRKKLR

SEQ ID NO: 51 - protein, 9 aa, synthetic construct
NLVERCFTD

SEQ ID NO: 52 - protein, 12 aa, synthetic construct
MLSLRQSIRFFK

SEQ ID NO: 53 - protein, 16 aa, synthetic construct
MLISRCKWSRFPGNQR

SEQ ID NO: 54 - skipped

SEQ ID NO: 55 - protein, 17 aa, synthetic construct
MQRKPTIRRKNLRLRRK

SEQ ID NO: 56 - protein, 11 aa, synthetic construct
KQAWKQKWRKK

SEQ ID NO: 57 - protein, 29 aa, synthetic construct
KWKLFKKIGAVLKVLTTGYGRKKRRQRRR

SEQ ID NO: 58 - protein, 34 aa, synthetic construct
KWKLFKKIGAVLKVLTTGRQIKIWFQNRRMKWKK

SEQ ID NO: 59 - protein, 36 aa, synthetic construct
MHHHHHHKWKLFKKIGAVLKVLTTGYGRKKRRQRRR

SEQ ID NO: 60 - protein, 290 aa, synthetic construct
MHHHHHHGGGGSGGGGSGGASTGTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGREIS

SEQ ID NO: 61 - protein, 317 aa, synthetic construct
MHHHHHHGGGGSGGGGSGGASTGTGRKKRRQRRRPPQGGGGSGGGGSGGGTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGREIS

SEQ ID NO: 62 - protein, 327 aa, synthetic construct
MHHHHHHGGGGSGGGGSGGASTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGRSSDDEATADSQHAAPPKKKRKVGGSGGGSGGGSGGGRGTEIS

SEQ ID NO: 63 - protein, 14 aa, synthetic construct
CLLKKLLKKLLKKC

SEQ ID NO: 64 - protein, 14 aa, synthetic construct
GLLKKLLKKLLKKG

SEQ ID NO: 65 - protein, 11 aa, synthetic construct
YARAAARQARA

SEQ ID NO: 66 - protein, 30 aa, synthetic construct
YGRKKRRQRRRCKWKLFKKIGAVLKVLTTG

SEQ ID NO: 67 - protein, 42 aa, synthetic construct
YGRKKRRQRRRCWEAKLAKALAKALAKHLAKALAKALKACEA

SEQ ID NO: 68 - protein, 35 aa, synthetic construct
HHHHHHKWKLFKKIGAVLKVLTTGYARAAARQARA

SEQ ID NO: 69 - protein, 33 aa, synthetic construct
HHHHHHKWKLFKKIGAVLKVLTTGRRRRRRRRR

SEQ ID NO: 70 - protein, 50 aa, synthetic construct
HHHHHHKWKLFKKIGAVLKVLTTGGWTLNSAGYLLKINLKALAALAKKIL

SEQ ID NO: 71 - protein, 43 aa, synthetic construct
HHHHHHKKALLALALHHLAHLALHLALALKKAYARAAARQARA

SEQ ID NO: 72 - protein, 31 aa, synthetic construct
HHHHHHCLLKKLLKKLLKKCYARAAARQARA

SEQ ID NO: 73 - protein, 324 aa, synthetic construct
MHHHHHHGGGGSGGGGSGGASTGIRMVSKCEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGQVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKGGSGGGSGGGSGWIRASSGGRSSDDEATADSQHAAPPKKKRKVGGSGGGSGGGSGGGRGTEIS

SEQ ID NO: 74 - protein, 1414 aa, synthetic construct
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGRSSDDEATADSQHAAPPKKKRKVGGSGGGSGGGSGGGRHHHHHH

SEQ ID NO: 75 - RNA, 42 nt, synthetic construct
  source 1..42: mol_type = other RNA
gagtccgagcagaagaagaagttttagagctatgctgttttg

SEQ ID NO: 76 - RNA, 69 nt, synthetic construct
  source 1..69: mol_type = other RNA
aaacagcatagcaagttaaaataaggctagtccgttatcaacttgaaaaagtggcaccgagtcggtgct

SEQ ID NO: 77 - RNA, 69 nt, synthetic construct; identical to SEQ ID NO: 76
  source 1..69: mol_type = other RNA

SEQ ID NO: 78 - RNA, 42 nt, synthetic construct
  source 1..42: mol_type = other RNA
gtgtattttgacctacgaatgttttagagctatgctgttttg

SEQ ID NO: 79 - RNA, 74 nt, synthetic construct
  source 1..74: mol_type = other RNA
aacagcatagcaagttaaaataaggctagtccgttatcaacttgaaaaagtggcaccgagtcggtgcttttttt

SEQ ID NO: 80 - protein, 246 aa, synthetic construct
MHHHHHHMAMSSFLINSNYVDPKFPPCEEYSQSDYLPSDHSPGYYAGGQRRESSFQPEAGFGRRAACTVQRYPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 81 - protein, 17 aa, synthetic construct
HHHHHHYARAAARQARA

SEQ ID NO: 82 - protein, 41 aa, synthetic construct
YARAAARQARAWEAKLAKALAKALAKHLAKALAKALKACEA

SEQ ID NO: 83 - protein, 39 aa, synthetic construct
RRRRRRRRRWEAKLAKALAKALAKHLAKALAKALKACEA

SEQ ID NO: 84 - protein, 51 aa, synthetic construct
KETWWETWWTEWSQPKKKRKVWEAKLAKALAKALAKHLAKALAKALKACEA

SEQ ID NO: 85 - protein, 37 aa, synthetic construct
LCLRPVGWEAKLAKALAKALAKHLAKALAKALKACEA

SEQ ID NO: 86 - protein, 40 aa, synthetic construct
RRLSYSRRRFWEAKLAKALAKALAKHLAKALAKALKACEA

SEQ ID NO: 87 - protein, 36 aa, synthetic construct
KFTIVFPHNQKGNWKNVPSNYHYCPYARAAARQARA

SEQ ID NO: 88 - protein, 34 aa, synthetic construct
LIRLWSHLIHIWFQNRRLKWKKKYARAAARQARA

SEQ ID NO: 89 - protein, 31 aa, synthetic construct
GLFEALLELLESLWELLLEAYARAAARQARA

SEQ ID NO: 90 - protein, 29 aa, synthetic construct
KWKLFKKIGAVLKVLTTGYARAAARQARA

SEQ ID NO: 91 - protein, 35 aa, synthetic construct
CCCCCCKWKLFKKIGAVLKVLTTGYARAAARQARA

SEQ ID NO: 92 - protein, 32 aa, synthetic construct
KWKLFKKIGAVLKVLTTGGGSYARAAARQARA

SEQ ID NO: 93 - protein, 36 aa, synthetic construct
KWKLFKKIGAVLKVLTTGGGSGGGSYARAAARQARA

SEQ ID NO: 94 - protein, 41 aa, synthetic construct
KWKLFKKIGAVLKVLTTGGGSGGGSGGGSGYARAAARQARA

SEQ ID NO: 95 - protein, 35 aa, synthetic construct
HHHHHHKWKLFKKIGAVLKVLTTGYGRKKRRQRRR

SEQ ID NO: 96 - protein, 41 aa, synthetic construct
HHHHHHKWKLFKKIGAVLKVLTTGYARAAARQARACCCCCC

SEQ ID NO: 97 - protein, 32 aa, synthetic construct
HHHKWKLFKKIGAVLKVLTTGYARAAARQARA

SEQ ID NO: 98 - protein, 41 aa, synthetic construct
HHHHHHHHHHHHKWKLFKKIGAVLKVLTTGYARAAARQARA

SEQ ID NO: 99 - protein, 36 aa, synthetic construct
HHHAHHHKWKLFKKIGAVLKVLTTGYARAAARQARA

SEQ ID NO: 100 - protein, 38 aa, synthetic construct
HAHHAHHAHKWKLFKKIGAVLKVLTTGYARAAARQARA

SEQ ID NO: 101 - protein, 35 aa, synthetic construct
KWKLFKKIGAVLKVLTTGHHHHHHYARAAARQARA

SEQ ID NO: 102 - protein, 41 aa, synthetic construct
HHHHHHKWKLFKKIGAVLKVLTTGYARAAARQARAHHHHHH

SEQ ID NO: 103 - RNA, 36 nt, synthetic construct
  source 1..36: mol_type = other RNA
aattatggggattactaggagttttagagctatgct

SEQ ID NO: 104 - protein, 38 aa, synthetic construct
HHHHHHKWKLLRRAAKKAARRYLKLLLKQLKLHHHHHH

SEQ ID NO: 105 - protein, 38 aa, synthetic construct
HHHHHHWLKLLRRAAKKAARLYRKLLRKARKLHHHHHH

SEQ ID NO: 106 - protein, 38 aa, synthetic construct
HHHHHHKRKKKRRAKKKRAWLYLALLLWALALHHHHHH

SEQ ID NO: 107 - protein, 38 aa, synthetic construct
HHHHHHKRQLKRKLRKWKRLLRLLRLLARLWLHHHHHH

SEQ ID NO: 108 - protein, 37 aa, synthetic construct
HHHHHHLLKLWSRLLKLWTQGRRLKAKRAKAHHHHHH

SEQ ID NO: 109 - protein, 34 aa, synthetic construct
HHHHHHWYLALLALYWQRAKAKTRQRRRHHHHHH

SEQ ID NO: 110 - protein, 33 aa, synthetic construct
HHHHHHWARLARAFARAIKKLYARALRRQARTG

SEQ ID NO: 111 - protein, 33 aa, synthetic construct
HHHHHHKWKLARAFARAIKKLYARALRRQARTG

SEQ ID NO: 112 - protein, 39 aa, synthetic construct
HHHHHHKWKLARAFARAIKKLYARALRRQARTGHHHHHH

SEQ ID NO: 113 - protein, 34 aa, synthetic construct
KWKLARAFARAIKKLGGSGGGSYARALRRQARTG

SEQ ID NO: 114 - protein, 36 aa, synthetic construct
HHHHHHKWKLARAFARALRAIKKLYARALRRQARTG

SEQ ID NO: 115 - protein, 27 aa, synthetic construct
KWKLARAFARAIKKLYARALRRQARTG

SEQ ID NO: 116 - protein, 40 aa, synthetic construct
HHHHHHKWAKLLRAFAKAIKKLYARLARRQARTGHHHHHH

SEQ ID NO: 117 - protein, 38 aa, synthetic construct
HHHHHHLALARWARYFRILAKLKRTKRGQAKAHHHHHH

SEQ ID NO: 118 - protein, 39 aa, synthetic construct
HHHHHHKWKIARAFARSLKKLYARLLARQAKTGHHHHHH

SEQ ID NO: 119 - protein, 31 aa, synthetic construct
HHHHHHLLKLWSRLLKLWTQGRRLKAKRAKA

SEQ ID NO: 120 - protein, 37 aa, synthetic construct
HHHHHHLAKLFKWLRALIRQGAKRKTKRASAHHHHHH

SEQ ID NO: 121 - protein, 32 aa, synthetic construct
LLKLWSRLLKLWTQGGSGGGSGRRLKAKRAKA

SEQ ID NO: 122 - protein, 42 aa, synthetic construct
HHHHHHLLKLWSRLLKTWTQGRRLKAKSAQASTRQAHHHHHH

SEQ ID NO: 123 - protein, 33 aa, synthetic construct
HHHHAAVLKLWKRLLKLFRKGRRLKAKRAKAKR

SEQ ID NO: 124 - protein, 31 aa, synthetic construct
HHHHHHFLKIWSRLIKIWTQGRRKGAQAAFR

SEQ ID NO: 125 - protein, 38 aa, synthetic construct
HHHHHHVLKLWSRILKAFTQGRRMAAKRAKCNHHHHHH

SEQ ID NO: 126 - protein, 37 aa, synthetic construct
HHHHHHLLKLWSRLLKEWTQGRRLEAKRAEAHHHHHH

SEQ ID NO: 127 - protein, 34 aa, synthetic construct
HHHHHHLLCLWSRLLKLWTQGERLKAKCAKACER

SEQ ID NO: 128 - protein, 35 aa, synthetic construct
HHHHHHVWKLFWTLLAAIYGRGKARQKRAKRQARG

SEQ ID NO: 129 - protein, 35 aa, synthetic construct
ALLGLFIKWVKKVGTLFRKAKAGAQNRRAKAQKGK

SEQ ID NO: 130 - protein, 37 aa, synthetic construct
HHHHHHKRKRRSKKRKLWTQGWLLLALLALAHHHHHH

SEQ ID NO: 131 - protein, 37 aa, synthetic construct
HHHHHHKLKLRSRLKWGRTQLWRALAKKALLHHHHHH

SEQ ID NO: 132 - protein, 36 aa, synthetic construct
HHHHHHQFLCFWLNKMGKHNTVWHGRHLKCHKRGKG

SEQ ID NO: 133 - protein, 35 aa, synthetic construct
HHHHHHLLYLWRRLLKFWCAGRRVYAKCAKAYGCF

SEQ ID NO: 134 - protein, 39 aa, synthetic construct
HHHHHHLLKLWRRLLKLFRKALRALAKRAKSALKRAQAA

SEQ ID NO: 135 - protein, 39 aa, synthetic construct
HHHHHHLLKLWSRLLKLWTQALRALAKRAKALAHHHHHH

SEQ ID NO: 136 - protein, 31 aa, synthetic construct
LIKLWSRFIKFWTQGRRIKAKLARAGQSWFG

SEQ ID NO: 137 - protein, 19 aa, synthetic construct
HHHHHHFRKLWLAIVRAKK

SEQ ID NO: 138 - protein, 35 aa, synthetic construct
HHHHHHKWKLFWEAKLAKYARAAARQARAARQARA

SEQ ID NO: 139 - protein, 35 aa, synthetic construct
HHHHHHHMAHLWESNARKFWKKAFAQHAAAHIAEA

SEQ ID NO: 140 - protein, 35 aa, synthetic construct
LHHHSHHLIHIWLLFKLKLKKKKAARRARRARRHH

SEQ ID NO: 141 - protein, 35 aa, synthetic construct
HHHHHHCLLKKWEAKLAKKIGGGGRQARAKALAKA

SEQ ID NO: 142 - protein, 35 aa, synthetic construct
YHHHHHKWKKRWEAKLAKALRAAGRQARAKALAKA

SEQ ID NO: 143 - protein, 35 aa, synthetic construct
IVRHEHCMIHLWYKNLAKYCSTSHARRLARRRAHH

SEQ ID NO: 144 - protein, 35 aa, synthetic construct
HHHHHHHHRQRRRWEARGGFLGGGGYARAARQARA

SEQ ID NO: 145 - protein, 35 aa, synthetic construct
HHHHHHKLIHIWEAKLFKKIRAAARQARARRAAKA

SEQ ID NO: 146 - protein, 35 aa, synthetic construct
HHHHHHKLLKRWEAKLAKALAKALAKHLAKALAKA

SEQ ID NO: 147 - protein, 35 aa, synthetic construct
HHHHHHCLIHIWEAKLAKKCGGGGYARAAARQARA

SEQ ID NO: 148 - protein, 35 aa, synthetic construct
RLHHSHHLIHIWLLFKLKLKKKKRAARRARRHHHL

SEQ ID NO: 149 - protein, 35 aa, synthetic construct
GHHHHHHHLIHIWEAKLAKLAKALARAAARQARAK

SEQ ID NO: 150 - protein, 35 aa, synthetic construct
HHHHHHHHRQRRRWEARGFLGGGGYARAARQARAA

SEQ ID NO: 151 - protein, 35 aa, synthetic construct
YGRKKRYMLRLWYQNLRMYCKKAYAQHRARQHAKL

SEQ ID NO: 152 - protein, 35 aa, synthetic construct
LHHHHHKLIHIWEAKLAKALAKALARRAAARQARA

SEQ ID NO: 153 - protein, 35 aa, synthetic construct
HHHHHHCMKVVWEIVLAKYKGGGGRARAASRRARA

SEQ ID NO: 154 - DNA, 72 bp, synthetic construct
  source 1..72: mol_type = other DNA
tgaaatggagagctaaattatggggattacaagcttgatagcgaaggggcagcaatgagttgacactacaga

SEQ ID NO: 155 - protein, 1353 aa, synthetic construct
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGRSSDDEATADSQHAAPPKKKRKVGGSGGGSGGGSGGGRHHHHHH

SEQ ID NO: 156 - DNA, 1631 bp, synthetic construct
  source 1..1631: mol_type = other DNA
aagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattctgcagtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaa

SEQ ID NO: 157 - RNA, 42 nt, synthetic construct
  source 1..42: mol_type = other RNA
aatttctactgttgtagatctgatggtccatgtctgttactc

SEQ ID NO: 158 - protein, 14 aa, synthetic construct
  VARIANT 5: note = X is N, Q, S, T, K, R, H, D, E, C, or Y (polar/hydrophilic residue)
  VARIANT 7: note = X is G, A, V, L, I, P, Y, F, W, M, or C (non-polar/hydrophobic residue)
  VARIANT 10: note = X is any amino acid other than P
  VARIANT 11: note = X is N, Q, S, T, K, R, H, D, E, C, or Y (polar/hydrophilic residue)
  VARIANT 12: note = X is  N, Q, S, T, K, R, H, D, E, C, or Y (polar/hydrophilic residue)
  VARIANT 13: note = X is  N, Q, S, T, K, R, H, D, E, C, or Y (polar/hydrophilic residue)
LKLWXRXLKXXXXG

SEQ ID NO: 159 - protein, 8 aa, synthetic construct
  VARIANT 3: note = X is G, A, V, L, I, P, Y, F, W, M, or C (non-polar/hydrophobic residue)
  VARIANT 4: note = X is any amino acid other than P
  VARIANT 7: note = X is N, Q, S, T, K, R, H, D, E, C, or Y (polar/hydrophilic residue)
RRXXAKXA

SEQ ID NO: 160 - RNA, 42 nt, synthetic construct
  source 1..42: mol_type = other RNA
gagtagcgcgagcacagctagttttagagctatgctgttttg

SEQ ID NO: 161 - RNA, 39 nt, synthetic construct
  source 1..39: mol_type = other RNA
aatttctactgttgtagatatccatccgacattgaagtt

SEQ ID NO: 162 - RNA, 41 nt, synthetic construct
  source 1..41: mol_type = other RNA
aatttctactcttgtagatccgatattcctcaggtactcca

SEQ ID NO: 163 - RNA, 39 nt, synthetic construct
  source 1..39: mol_type = other RNA
aatttctactcttgtagatctttcttcctttaggagaca

SEQ ID NO: 164 - RNA, 39 nt, synthetic construct
  source 1..39: mol_type = other RNA
aatttctactcttgtagataagaactaaaattccagatg

SEQ ID NO: 165 - RNA, 39 nt, synthetic construct
  source 1..39: mol_type = other RNA
aatttctactcttgtagatggggcagattcaggtctgag

SEQ ID NO: 166 - RNA, 39 nt, synthetic construct
  source 1..39: mol_type = other RNA
aatttctactcttgtagatatccatccgacattgaagtt

SEQ ID NO: 167 - RNA, 41 nt, synthetic construct; identical to SEQ ID NO: 162
  source 1..41: mol_type = other RNA

SEQ ID NO: 168 - RNA, 41 nt, synthetic construct
  source 1..41: mol_type = other RNA
aatttctactcttgtagatttagagtctcgtgatgtttaag

SEQ ID NO: 169 - protein, 31 aa, synthetic construct
HHHHHHFLKFWSRLFKFWTQGRRKGAQAAFR

SEQ ID NO: 170 - protein, 31 aa, synthetic construct
HHHHHHILKIWSRLIKIWTQGRRKGAQAAIR

SEQ ID NO: 171 - protein, 32 aa, synthetic construct
HHHHHHFLKIWSRALIKIWTQGLRKGAQAAKR

SEQ ID NO: 172 - protein, 31 aa, synthetic construct
HHHHHHFLKIWSRLIKIWTQGLRKGAQAAKR

SEQ ID NO: 173 - protein, 31 aa, synthetic construct
HHHHHHVLKIWSRLIKIWTQGRRKGAQAAVR

SEQ ID NO: 174 - protein, 31 aa, synthetic construct
HHHHHHFLKVWSRLVKVWTQGRRKGAQAAFR

SEQ ID NO: 175 - protein, 31 aa, synthetic construct
HHHHHHVLKVWSRLVKVWTQGRRKGAQAAVR

SEQ ID NO: 176 - protein, 31 aa, synthetic construct
HHHHHHFLKIWQRLIKIWQQGRRKGAQAAFR

SEQ ID NO: 177 - protein, 31 aa, synthetic construct
HHHHHHFLKIWNRLIKIWNNGRRKGANAAFR

SEQ ID NO: 178 - protein, 30 aa, synthetic construct
HHHHHHFLKIWSRLIKIWTQGWRTGAQAGF

SEQ ID NO: 179 - protein, 30 aa, synthetic construct
HHHHHHLLKIWSRLIKGWTQGWRTIAQALG

SEQ ID NO: 180 - protein, 34 aa, synthetic construct
HHHHHHFLKIWSRLIKIWTQGALWKTLLKKVLKA

SEQ ID NO: 181 - protein, 31 aa, synthetic construct
HHHHHHFLKIWSRLIKIWPQPRRKGAQAAFR

SEQ ID NO: 182 - protein, 31 aa, synthetic construct
FLKIWSRLIKIWTQGGSGGGSRRKGAQAAFR

SEQ ID NO: 183 - protein, 30 aa, synthetic construct
LIRKWIHLIHSWFQNLRRLYARAAARQARA

SEQ ID NO: 184 - protein, 31 aa, synthetic construct
LLRLWSHLIHLWTQGGSGGGSRRLKAKRAKA

SEQ ID NO: 185 - protein, 31 aa, synthetic construct
FLKIWSHLIHIWTQGGSGGGSRRLKAKRAKA

SEQ ID NO: 186 - protein, 32 aa, synthetic construct
LLKLWSRLLKLWTQGGSPPPSGRRLKAKRAKA

SEQ ID NO: 187 - protein, 28 aa, synthetic construct
HHHHHHMVRVLTRFLRIGARCRRPPVVR

SEQ ID NO: 188 - protein, 30 aa, synthetic construct
HHHHHHWITWLFKRLKIRRAAGQSKFRIAG

SEQ ID NO: 189 - protein, 30 aa, synthetic construct
HHHHHHWITWLRKILKRFRKAAQSGFRIAG

SEQ ID NO: 190 - protein, 30 aa, synthetic construct
HHHHHHWITWLRKILKRFGKAAQSGFRIAR

SEQ ID NO: 191 - protein, 30 aa, synthetic construct
HHHHHHWITWLRKILKRLGGAAQSIITGGQ

SEQ ID NO: 192 - protein, 30 aa, synthetic construct
WITWLFKRLKIRRAAGGSGGGSQSKFRIAG

SEQ ID NO: 193 - protein, 36 aa, synthetic construct
HHHHHHWITWLFKRLKIRRAAGGSGGGSQSKFRIAG

SEQ ID NO: 194 - protein, 32 aa, synthetic construct
LLKLESRELKLWTQGGSGGGSGRRLKAKRAKA

SEQ ID NO: 195 - protein, 34 aa, synthetic construct
KWKLARAEARAEKKLGGSGGGSYARALRRQARTG

SEQ ID NO: 196 - protein, 32 aa, synthetic construct
LLKLWSRLLKLWTQGGSGEGSGRRLKAKRAKA

SEQ ID NO: 197 - protein, 32 aa, synthetic construct
LLKLWSRLEKLWTQGGSGGGSGRRLKAKRAKA

SEQ ID NO: 198 - protein, 42 aa, synthetic construct
HHHHHHLLKEWSRLLKTWTQGRRLKAKSAQASTRQAHHHHHH

SEQ ID NO: 199 - protein, 43 aa, synthetic construct
HHHHHHKKALLALALHHLAHLALHLELALKKAYARAAARQARA

SEQ ID NO: 200 - protein, 23 aa, synthetic construct
WIRLFTKLWRIFQQGKRIKAKRA

SEQ ID NO: 201 - protein, 29 aa, synthetic construct
WIRLFTKLWRIFQQGGSGGGSKRIKAKRA

SEQ ID NO: 202 - protein, 23 aa, synthetic construct
WIRLFTKLWRIFRQGKRIKAKAA

SEQ ID NO: 203 - protein, 29 aa, synthetic construct
WIRLFTKLWRIFRQGGSGGGSKRIKAKAA

SEQ ID NO: 204 - protein, 25 aa, synthetic construct
ILKLWSRLIKIWTQGRRLGAQAALR

SEQ ID NO: 205 - protein, 31 aa, synthetic construct
ILKLWSRLIKIWTQGGSGGGSRRLGAQAALR

SEQ ID NO: 206 - protein, 25 aa, synthetic construct
ILKLWSRLIKIWTQGRRKKAQAAKR

SEQ ID NO: 207 - protein, 31 aa, synthetic construct
ILKLWSRLIKIWTQGGSGGGSRRKKAQAAKR

SEQ ID NO: 208 - protein, 25 aa, synthetic construct
LLKIWSRLIKIWTQGRRLGARAARA

SEQ ID NO: 209 - protein, 31 aa, synthetic construct
LLKIWSRLIKIWTQGGSGGGSRRKKARAARA

SEQ ID NO: 210 - protein, 26 aa, synthetic construct
LLKLWSRLIKIWTKGRRKKARAAQAR

SEQ ID NO: 211 - protein, 32 aa, synthetic construct
LLKLWSRLIKIWTKGGSGGGSRRKKARAAQAR

SEQ ID NO: 212 - protein, 25 aa, synthetic construct
LLKIWSRLIKIWTQGRRLGARAQAR

SEQ ID NO: 213 - protein, 31 aa, synthetic construct
LLKIWSRLIKIWTQGGSGGGSRRLGARAQAR

SEQ ID NO: 214 - protein, 27 aa, synthetic construct
LLKIWSRLIKIWTQGRRLGARAARQAR

SEQ ID NO: 215 - protein, 33 aa, synthetic construct
LLKIWSRLIKIWTQGRRLGGSGGGSARAARQAR

SEQ ID NO: 216 - protein, 25 aa, synthetic construct
KLKIWSRLIRKWTKGLRLGAQAQAR

SEQ ID NO: 217 - protein, 31 aa, synthetic construct
KLKIWSRLIRKWTKGGSGGGSLRLGAQAQAR

SEQ ID NO: 218 - protein, 15 aa, synthetic construct
LLKIWSRLIKIWTQG

SEQ ID NO: 219 - protein, 21 aa, synthetic construct
LLKIWSRLIKIWTQGGSGGGS

SEQ ID NO: 220 - protein, 28 aa, synthetic construct
LLKIWSRLIKIWTQGRGRESRKPRKSRQ

SEQ ID NO: 221 - protein, 34 aa, synthetic construct
LLKIWSRLIKIWTQGGSGGGSRGRESRKPRKSRQ

SEQ ID NO: 222 - protein, 28 aa, synthetic construct
LLKIWSRLIKIWTQGLGLLVLRVRAGKR

SEQ ID NO: 223 - protein, 34 aa, synthetic construct
LLKIWSRLIKIWTQGGSGGGSLGLLVLRVRAGKR

SEQ ID NO: 224 - protein, 29 aa, synthetic construct
FLHSWKKFLKAFLGRILQSARAGARQARA

SEQ ID NO: 225 - protein, 24 aa, synthetic construct
FLHLWQKFLKFLSTGRKIGARQAK

SEQ ID NO: 226 - protein, 37 aa, synthetic construct
HHHHHHFLKIWSRLIKIWTQGRRKGAQAAFRHHHHHH

SEQ ID NO: 227 - protein, 31 aa, synthetic construct
HHHHHHRFAAQAGKRRGQTWIKILRSWIKLF

SEQ ID NO: 228 - protein, 31 aa, synthetic construct
HHHHFLHHSWIKKILRTWIRRGQQAGKFAAR

SEQ ID NO: 229 - protein, 37 aa, synthetic construct
HHHHHHAKARKAKLRRGQTWLKLLRSWLKLLHHHHHH

SEQ ID NO: 230 - protein, 37 aa, synthetic construct
HHHHLLHHSWLKKLLRTWLRRGQKAKLKARAHHHHHH

SEQ ID NO: 231 - protein, 32 aa, synthetic construct
HHHHHHRRALLALALHHLAHLALHLALALRRA

SEQ ID NO: 232 - protein, 32 aa, synthetic construct
HHHHHHKKGLLGLGLHHLGHLGLHLGLGLKKG

SEQ ID NO: 233 - protein, 32 aa, synthetic construct
HHHHHHKKAIIAIAIHHIAHIAIHIAIAIKKA

SEQ ID NO: 234 - protein, 32 aa, synthetic construct
HHHHHHKKAVVAVAVHHVAHVAVHVAVAVKKA

SEQ ID NO: 235 - protein, 32 aa, synthetic construct
HHHHHHKKALLAALLHHLAHLLAHLAAALKKL

SEQ ID NO: 236 - protein, 26 aa, synthetic construct
HHHHHHGLFKALLKLLKSLWKLLLKA

SEQ ID NO: 237 - protein, 30 aa, synthetic construct
HHHHHHGLFKALLKLHHLKHSLWHKLLLKA

SEQ ID NO: 238 - protein, 32 aa, synthetic construct
HHHHHHALALALLKLHHLKHLLAHKLLAKAAA

SEQ ID NO: 239 - protein, 28 aa, synthetic construct
HHHHHHALLKALAKLLLALAKLLLKAAA

SEQ ID NO: 240 - protein, 31 aa, synthetic construct
HHHHHHKLKLRSRLKWGRTQLWRALAKKALL

SEQ ID NO: 241 - protein, 32 aa, synthetic construct
HHHHHHVLKLWSRILKAFTQGRRMAAKRAKCN

SEQ ID NO: 242 - protein, 31 aa, synthetic construct
HHHHHHLLKLWSRLLKEWTQGRRLEAKRAEA

SEQ ID NO: 243 - protein, 24 aa, synthetic construct
RLKFLRRLMRLIRSGLRVFHRACV

SEQ ID NO: 244 - protein, 36 aa, synthetic construct
RFKLLNRMLRRFRSSALTLVIAVALIMLRWADKLIK

SEQ ID NO: 245 - protein, 67 aa, synthetic construct
FLKLMRKLFKRYRKGKALLKGDLAKRLLKAKAWYMLPLVFHRIRKATIGPLHCRAKMRKRPGRREAR

SEQ ID NO: 246 - protein, 30 aa, synthetic construct
LMKLLQKIYRLLRRKHLKPNRYSCDLLRQH

SEQ ID NO: 247 - protein, 30 aa, synthetic construct
RFKFLQKFYRLYPKRSHNNKAPRLRLVLLA

SEQ ID NO: 248 - protein, 25 aa, synthetic construct
YYKIWQKLLRKLRRKKRSAACAILQ

SEQ ID NO: 249 - protein, 36 aa, synthetic construct
KLRLLRRFYRYIRNPTSLCKAKLIKKWYAVYQAARA

SEQ ID NO: 250 - protein, 34 aa, synthetic construct
KWRWLTKLIRRLPCLGDHLNKQSLAYDRAKSALR

SEQ ID NO: 251 - protein, 57 aa, synthetic construct
LFRMLRKFMRRLRRLSAALFLLKRQQQELFAGVKPLRVSKADVVLKRAFLLARRLDC

SEQ ID NO: 252 - protein, 30 aa, synthetic construct
LLKFLKRWWKLWKKDNRHSAKLTEWDLRLG

SEQ ID NO: 253 - protein, 27 aa, synthetic construct
LLRLMKKLIKRFTNLHLLMKSKRPSAV

SEQ ID NO: 254 - protein, 75 aa, synthetic construct
KWKILRKMLKKIQTRGAFDKLPRARDRKVWTGWLLDQNFWLAKGSKLRLLHKPLASRDRLKAKERHFHEHRALRK

SEQ ID NO: 255 - protein, 44 aa, synthetic construct
LLKFFSKLMKRFKRARHSLILRDAHRKQALWMAWLIVKKKHFLF

SEQ ID NO: 256 - protein, 21 aa, synthetic construct
RIRFMHRLLRRFCKVADKYAA

SEQ ID NO: 257 - protein, 75 aa, synthetic construct
LWRYMKRYLRFLHRRAEITLILQAYIFLHAKRARKRHGLFSAKGKKKEKWMLCHCLQLGLARTKKRALATAKLPP

SEQ ID NO: 258 - protein, 81 aa, synthetic construct
FLKLMTRMYKRLKCDAKKLHKGKHIANKATLLARFAQRLHQYARIKKRRKLWKLKYLPRLKYIKANNAWHLLKRAPWLALR

SEQ ID NO: 259 - protein, 45 aa, synthetic construct
FLKFYSRIFRRFKTFPRFKLRPAGAFLQLRHAKALKRWCRPALLK

SEQ ID NO: 260 - protein, 59 aa, synthetic construct
KLKLIRRFMKKFRTRLAVKIRAWDKAKPYADGLLASLLKRLRVPRCIMCHAKFILTQCK

SEQ ID NO: 261 - protein, 49 aa, synthetic construct
KLKLFNRYLKKLTRADAGLGLWAWSAAKELFLAEWANWKTYYRRLRPNK

SEQ ID NO: 262 - protein, 38 aa, synthetic construct
KFRLFQRWWRRLRTLRANSCRKAASSALCMAWNRGKCA

SEQ ID NO: 263 - protein, 38 aa, synthetic construct
FMKFLKKYFRFYTKCALRAYLHKAHKRLRTRSWILAQR

SEQ ID NO: 264 - protein, 32 aa, synthetic construct
IWKLLRKLLKKLRKEMMLLKSDKPAQHEKLHY

SEQ ID NO: 265 - protein, 43 aa, synthetic construct
KYKYLKRFLKFLRKEETRLLLAANHCYRALKNEFEYRAAKQAR

SEQ ID NO: 266 - protein, 58 aa, synthetic construct
LLRLFRKLFKFLRKGLGEPLLQGNKKLFKDLKLRHSKAALAFMSASFFAGDKLNGRWG

SEQ ID NO: 267 - protein, 56 aa, synthetic construct
YMRLMKRLLKWITTLALDYGRNLPLALRSRAKLPAFWLPIGDARRRKVLRLNYYRV

SEQ ID NO: 268 - protein, 43 aa, synthetic construct
RLRLFRKFYRKFTRRKLCVAKASTFRVLYANRTEARKYTLLLR

SEQ ID NO: 269 - protein, 54 aa, synthetic construct
KLRLIKRFLRFMNKLRVRAVPKKAARKLKEWQAWKTGEAWGDKAAFRLLDLNKC

SEQ ID NO: 270 - protein, 42 aa, synthetic construct
LWKLLKRYFKKMCKLAWKHRKGADPLVLLMMHAKKVLPLSGL

SEQ ID NO: 271 - protein, 33 aa, synthetic construct
LMRFIKRMMKLLTRSLKILGARGKELTRRGRWL

SEQ ID NO: 272 - protein, 36 aa, synthetic construct
KLKMLRKFIKMLPKLLRCRKLRWHCCAKSWHAHLYA

SEQ ID NO: 273 - protein, 31 aa, synthetic construct
KFKFLRRYMKKFKRAGKADDLELLAAWAKAI

SEQ ID NO: 274 - protein, 49 aa, synthetic construct
LMKLFKKMFRKMKRMLWAILLRLREDKAILTKEGLLLNKKRRKRFAAKM

SEQ ID NO: 275 - protein, 68 aa, synthetic construct
KWKFLRRFWKKLKHARAKMRLASRIFNKLRGERCHGAGVFIYRLDFNRPHGHARALRAIALKAAIKRR

SEQ ID NO: 276 - protein, 62 aa, synthetic construct
KIKLYRRFMKRICSKKRADWLLLCKALNEKTYKLKARYAARLAWSTKDKILKFLKAQRRTES

SEQ ID NO: 277 - protein, 46 aa, synthetic construct
FLRMYRKLWKKLKHLKAKQNAAQVLGKKAHALMLRARKLIFRMEFK

SEQ ID NO: 278 - protein, 51 aa, synthetic construct
ILKLFSKLIKRFKRWGACRDKLRRWKGRSPIHCLLIIDKKKARQLARCAAA

SEQ ID NO: 279 - protein, 45 aa, synthetic construct
KLKYLCKILKFFKRKAKRRLLDEAGNMGRALKRVNAVMAAHFDRL

SEQ ID NO: 280 - protein, 23 aa, synthetic construct
KFKLICKLWRWFHQRLATKFLRA

SEQ ID NO: 281 - protein, 79 aa, synthetic construct
WMKMYRRMLRRLHCVLHHILRKRKYFLWRLWKKQYTHRLSEALASALNYLLKRAALEKIVLRNKLKAKLAVNKQYAYAK

SEQ ID NO: 282 - protein, 23 aa, synthetic construct
KLRFLPKLLRLWSRRDLMNLKLR

SEQ ID NO: 283 - protein, 66 aa, synthetic construct
KFRYLCRLLKYMTKTAFDYKLKGLNHKKLFAALKSAVQAYYKRRLVNKLKARANRYKAGADESKLR

SEQ ID NO: 284 - protein, 21 aa, synthetic construct
RIRLLRRYLRLLRKHYSEHHE

SEQ ID NO: 285 - protein, 90 aa, synthetic construct
RFKFIKKYFKYLHKKKHERCMKIWAEYMHRDKSLLADKKKNARAKARRLAYAKTGLPEKPRSAAATRTKGLCDLLCKRRAILAACDAAHY

SEQ ID NO: 286 - protein, 59 aa, synthetic construct
FFRWLKRMFRRMTKRAKCLKAAWKWPNAWAKLLEKIPRCHKGNCLRRLLANKINILLKR

SEQ ID NO: 287 - protein, 35 aa, synthetic construct
RLKFFCKLWRKFRKAKYLLPELPIAARTPLLKYAQ

SEQ ID NO: 288 - protein, 57 aa, synthetic construct
LLRLLKKYFKKMRQDLRSASFPHALAAADKAKKRPIKLNIAKIMLMFRLDHHEAMYL

SEQ ID NO: 289 - protein, 29 aa, synthetic construct
KLKIFRKILRWMRKALLRRLSCGHTVGLA

SEQ ID NO: 290 - protein, 21 aa, synthetic construct
LLRFLCRLLRRWRCAKDLLRW

SEQ ID NO: 291 - protein, 32 aa, synthetic construct
KLRIYPKIWRLFRRRMTVLCELKYVKAAAKLA

SEQ ID NO: 292 - protein, 30 aa, synthetic construct
MLKLIKRLIRKMTRKNFASRKYLQAAATYW

SEQ ID NO: 293 - protein, 100 aa, synthetic construct
RFRYFKRFLRLFKKAFATKPKAKHRIAAGNFTRWRFAAALLAVPLCANDCRLKRNAKPRAQKAWDARWKPFELKCLAKEGIALRMKEHAHTFRPRNKRRQ

SEQ ID NO: 294 - protein, 76 aa, synthetic construct
WFKMFSRLWRKIKRILKAKCWKTHLRLHDRKARACLLLLKRAIWLHYVQMNWLYDLKAPAEDAAPGALLRGKRAMC

SEQ ID NO: 295 - protein, 65 aa, synthetic construct
FLKYLKRLWKMFNRDLAMKARKLAAPKAWMHIACYREPFTQALKMKLLRNLKALTTRWAHRPLKL

SEQ ID NO: 296 - protein, 33 aa, synthetic construct
LMKLMKKFLRMLNTKKAAYQTRCKAARYQTAML

SEQ ID NO: 297 - protein, 55 aa, synthetic construct
KLRFLKRMMRFWRRRKREWTSLAMVRAKLSRWAALAADLVLNFLAALNECAWGVK

SEQ ID NO: 298 - protein, 51 aa, synthetic construct
MLKMYQKLLRRFRRAKPAPKGASGCAFLLVARLWQMRRMKRAKASLVKCPL

SEQ ID NO: 299 - protein, 75 aa, synthetic construct
KIKIWRKYLRRLTQLRSSVWYWIGCHRRAALKLGQKFAKAWRCRALFMLYNRNGQLSALKKKKLAHRKTRRMLFK

SEQ ID NO: 300 - protein, 54 aa, synthetic construct
RMRIYCKLLRKLRRLAWLQRALEKFNYPRFALVIRLALKKKAKQAKRKLLWIRA

SEQ ID NO: 301 - protein, 31 aa, synthetic construct
KLRMFTKLWRLFKRKLAAFTEAKLKCNKKAC

SEQ ID NO: 302 - protein, 95 aa, synthetic construct
LYRMLRRLWKKLRKKIILMLKRTRHREMKCAGAYATKYRILRQAAMMRLIMDLLRLYKALLGLEPFRDLALAKEKNMRAIKNEDAFRQKSFLATC

SEQ ID NO: 303 - protein, 48 aa, synthetic construct
KFKLMRKFLKRFKTVKCGLTGTGALLKLTIQLKSRSRKEWAILLALLC

SEQ ID NO: 304 - protein, 44 aa, synthetic construct
KLRWLHKWFKLMQPMLAADDYQAAARLSKLIRALCCFRKLLKRH

SEQ ID NO: 305 - protein, 67 aa, synthetic construct
KLRLLRRIIRIFKNGENAALRKDNHLGLKGARPMRHRKAKFLLFKTYRDDRLPRTKNVLREALLRRL

SEQ ID NO: 306 - protein, 42 aa, synthetic construct
FLKLLHKIFRFLRKLRDWMACGFKKPLYKAWKKCLRLLKMLR

SEQ ID NO: 307 - protein, 59 aa, synthetic construct
RFRLIKRWLRWLRHLAKYNKDRAKVYATARRWKCWKARWSRLLLQGRCKIKARLWAAAE

SEQ ID NO: 308 - protein, 74 aa, synthetic construct
RFKLWRRIFRRLPSLKFWLKKYEPIAADGVKRWRRPMAAHARLDLLKHAGLRQAAACSKMPRTYAEFRKLKGLA

SEQ ID NO: 309 - protein, 20 aa, synthetic construct
KLRMLHRLIRWWCKKLLKPA

SEQ ID NO: 310 - protein, 34 aa, synthetic construct
IFKILKRLYRMFKKWLLAKYRAALGRAALLKRSK

SEQ ID NO: 311 - protein, 38 aa, synthetic construct
LWRMLHRLMRKLTRCGKVIYKASMAGALRKGLMFRRLQ

SEQ ID NO: 312 - protein, 49 aa, synthetic construct
RLKFFKKMYRRFQKTCKPFGRAQDIKLYLAKALARLHPLTRALKYYMLR

SEQ ID NO: 313 - protein, 35 aa, synthetic construct
FLKWFCKFMKKWKPLALVDMRKALLRVLGNKQKRL

SEQ ID NO: 314 - protein, 51 aa, synthetic construct
LLKLLQRFMKRWKRYLRFRLWLRKQCLIFTEIRLAALLMYAKMEKRWHKKA

SEQ ID NO: 315 - protein, 67 aa, synthetic construct
FLKFMKKLIKILKKAYQDERANATAAREAARLNKGELRKHHFFFIHGKTRALRATRHNRLRTKLNKA

SEQ ID NO: 316 - protein, 59 aa, synthetic construct
KLRMLRKFWRLMCQKADIAYPKWMRALRLRFKLAPLRAAENKVDKILSYKRCLYRQAGK

SEQ ID NO: 317 - protein, 31 aa, synthetic construct
KLRWYRRLLKFLRKRAKTLAKMKKGATLEAY

SEQ ID NO: 318 - protein, 77 aa, synthetic construct
MFKLFPRLLRKLRCLHSNIALKLLRYKNKAKDKLCLAKPWPLLLTKKAAWKMYKKQPKNIESLDQAPRHDLRKYQEL

SEQ ID NO: 319 - protein, 57 aa, synthetic construct
WIRWMNRLLRILRCKKIKLDDPKFFLRPRFLKARTDRASAKLANAMRRKAKIKCAHM

SEQ ID NO: 320 - protein, 23 aa, synthetic construct
RLKLLKKWMKMLKTAYWKVYVLK

SEQ ID NO: 321 - protein, 58 aa, synthetic construct
RFRFLRRLFRRWRQHAARCLCYPHDPAYEKDLMMAAALRLAKRIMCAIRNYALRHLML

SEQ ID NO: 322 - protein, 48 aa, synthetic construct
FLRWWRRMLKKWRCAAKHRAHLKLRMQALFSEHKRARNYLDRQLAMAK

SEQ ID NO: 323 - protein, 20 aa, synthetic construct
KIKFYNRFLRLMRRALVKFL

SEQ ID NO: 324 - protein, 73 aa, synthetic construct
KFKLWNKWLRRLSNKARSKLKCASKWEQAAWCNRAFRASVAGRKTLKANLRGLAELANVALQPRRTKRRAIAR

SEQ ID NO: 325 - protein, 33 aa, synthetic construct
KLRMLPRLIRRLKHARRIANKCRHAPAGVKIRL

SEQ ID NO: 326 - protein, 27 aa, synthetic construct
WLKLLKKIYKIWSTLAFKPKWRRSALK

SEQ ID NO: 327 - protein, 36 aa, synthetic construct
RMRILCRLYRFLQKLMKRARKAIPKFRRLACLTWFY

SEQ ID NO: 328 - protein, 40 aa, synthetic construct
RIRWYKKIWRILRKNLSRLQAKLELKYALGLSELLGRVLR

SEQ ID NO: 329 - protein, 37 aa, synthetic construct
RLKLMRKLLRFWKTLLRRRKARLLKCIGWDLGAAHGR

SEQ ID NO: 330 - protein, 62 aa, synthetic construct
LMRFMRRLMRRFCNALRRTRDRPALRDKKAKEAALLPRVTLNVGFVRKDKLARSVRAEKARR

SEQ ID NO: 331 - protein, 29 aa, synthetic construct
FFRFYQKYLKRIRKNLFLLQAKYKWRDAL

SEQ ID NO: 332 - protein, 30 aa, synthetic construct
RWKYFKKLFKLIKCLTYRLDLKGLRLLFKD

SEQ ID NO: 333 - protein, 34 aa, synthetic construct
KLRYLQKWYKRYSRAYGLMCAKRARHLWPKFANA

SEQ ID NO: 334 - protein, 25 aa, synthetic construct
FFKYLHKLLKLLRCLAQDVKTKRRR

SEQ ID NO: 335 - protein, 49 aa, synthetic construct
KFKWYCRLFRLFKHKWSLLLRELAMLCYLHCAKLAGAACLQRWKKQLVK

SEQ ID NO: 336 - protein, 51 aa, synthetic construct
KMKYMCRLMRKIRTLMPEPFKALALLAYLATRLQELFVRMAARVKRRDLKW

SEQ ID NO: 337 - protein, 40 aa, synthetic construct
RLKIWKRFFKKYRTLNKLISHARLLRWKLGLRLIHGRAGR

SEQ ID NO: 338 - protein, 32 aa, synthetic construct
LFKYYCRMWRLLNKCQALTRKMHRCLIALKAK

SEQ ID NO: 339 - protein, 38 aa, synthetic construct
YFKFMKRLLRKIRKLSRWRMLLRWAAPKADADANLWAI

SEQ ID NO: 340 - protein, 52 aa, synthetic construct
RWRLIRRMFRILSSWKPARQKANLRLRRIHLLLKPRLAKADKLALCPNFSAL

SEQ ID NO: 341 - protein, 47 aa, synthetic construct
MLKLMKRLYKLLKKAQLRRAYIAQPMNCHRRLRLKAQWLDRDAYIKN

SEQ ID NO: 342 - protein, 99 aa, synthetic construct
KYKFFKKIFRLLKKTMAFNALQHKLPHKGAKLLRKNGLRNSRPEKRRRKDKKKTNDFILKAMFKAHAKMHLQELRRTHRAEKARACAAACYLRVFQREQ

SEQ ID NO: 343 - protein, 61 aa, synthetic construct
LIKFLRRLLRKWTSRTCEKAASMHKAMRAFSVATLWLIALVLKYTARAAFLAAIRYRWKNC

SEQ ID NO: 344 - protein, 72 aa, synthetic construct
RLKLLTRMYKYWRKDQARLKVHLHFRRSYLAEKKAMTKQKKVNKHANNTAWKLRLAHLKRATDLMHRAELSS

SEQ ID NO: 345 - protein, 36 aa, synthetic construct
FWKYMKRLMRRYHRKCAKAECRKLMAAMAMYRHLFA

SEQ ID NO: 346 - protein, 58 aa, synthetic construct
YIRFLKKLFKKIRTCDAWPLHTNKLTRLYVAHLVTVRRLRALRRGILTVLKCKLRKLG

SEQ ID NO: 347 - protein, 24 aa, synthetic construct
LLKYWTRFWRWFRRIRLVEARLLK

SEQ ID NO: 348 - protein, 33 aa, synthetic construct
MWRMLSKIYKKLTRASLDLALSRAFAHRRQIAK

SEQ ID NO: 349 - protein, 66 aa, synthetic construct
KWRIMKRMYRRWRCLIKNAAKRKKTKIPKRSALKAAGEANFRRLARAVKIDANDTALLANKPTSMN

SEQ ID NO: 350 - protein, 21 aa, synthetic construct
KWRLLRRLLRMWKTYNFGLCR

SEQ ID NO: 351 - protein, 23 aa, synthetic construct
IFRLFKKFLKKLTHLRMAKLGIQ

SEQ ID NO: 352 - protein, 28 aa, synthetic construct
LLRLLQRLFRRLHQNKEFIAIKAGWRVA

SEQ ID NO: 353 - protein, 70 aa, synthetic construct
RLKWIKKIYKRLTRKIFHRARAILMSCTKNRWDKQDAAKALKKLQRLRNRLLVLGELLKITIAIIYHTAK

SEQ ID NO: 354 - protein, 30 aa, synthetic construct
FWRYFKKFLRFLRRLPAHNLKKLQAARFGC

SEQ ID NO: 355 - protein, 34 aa, synthetic construct
RFKLYRRMLKRICSLGPAIAAARDGHASAFALQR

SEQ ID NO: 356 - protein, 54 aa, synthetic construct
KIRWFQRLLKRLRNAARNLQPLVALDHKQLGRKWLNFPLRLPIIILAATRENRL

SEQ ID NO: 357 - protein, 33 aa, synthetic construct
KLRFLQRFWRLLKRNKTLAKVVRLGLCRPDRNT

SEQ ID NO: 358 - protein, 52 aa, synthetic construct
RFKWMRRIMRKYQKIFRTAWVSCNAAMPAAKGKRGNLAGRKLAAARCAKRLY

SEQ ID NO: 359 - protein, 26 aa, synthetic construct
WMKMLRRYWKRLKRAVAAAAHAGCKD

SEQ ID NO: 360 - protein, 90 aa, synthetic construct
KFKILKRFLRLYTRVSAQYFYLFNAKKMDRFAAVVAIAAKARPNLPRAALHNARKMKGKAKAARSIKWMGKAKTAKSVKAPSRRASSTVR

SEQ ID NO: 361 - protein, 20 aa, synthetic construct
IIKFLCRLMKWFCRALHKKA

SEQ ID NO: 362 - protein, 69 aa, synthetic construct
RLRYMNRFYKRLRKRRILATLCWFKFKHAENLKRKQTSYCALEEEKRLQHTLALLQAAVRVLRVRRKAR

SEQ ID NO: 363 - protein, 28 aa, synthetic construct
LLKLMKRYYRWLRQAFAAKLMPARYKSA

SEQ ID NO: 364 - protein, 40 aa, synthetic construct
FMKYLKRMMKLFHRWRYRKFELWLLRPKMLKLMRMPVKAA

SEQ ID NO: 365 - protein, 23 aa, synthetic construct
LMRFYNKYYKKLRKEGLLWLCKA

SEQ ID NO: 366 - protein, 21 aa, synthetic construct
KFKYYRRLYRRFSTLASAHLA

SEQ ID NO: 367 - protein, 41 aa, synthetic construct
FMRYINKYLRYLKKLARASILAHRPFKADCKEGKYLALLRK

SEQ ID NO: 368 - protein, 26 aa, synthetic construct
LLKWYRRFLKRIQTKFALKCISASAR

SEQ ID NO: 369 - protein, 49 aa, synthetic construct
RYRLLKRFWKFFHRRKLRGPLAERKALIIGLAKQSESAKIAPAAKELAM

SEQ ID NO: 370 - protein, 100 aa, synthetic construct
LFRIYKRIMRLMRKAARMRQLLDLSWQFARWFDVGIAKDLRRRPMAALRLLALLKTCYHRTQMQWNAVVHKKKRAKRQQKHRTKATMCCLRLAALAAERV

SEQ ID NO: 371 - protein, 74 aa, synthetic construct
KIRWIRRLLKKLKKLGFAAWEWINLRAKTLALARYQRLAQAGLAMKQNRFAQSCRLMKFWCAFMFLQRVRKEKY

SEQ ID NO: 372 - protein, 41 aa, synthetic construct
YYKFLRKMWKKLKHYRRLLGVRETPLKVYRALARTCKLKQA

SEQ ID NO: 373 - protein, 48 aa, synthetic construct
IFRLIRRYYRRWSKRKPLKAQLRKLAKLCMALLWWIRLAGLVRRILGR

SEQ ID NO: 374 - protein, 39 aa, synthetic construct
RYKYLNKILRRLRNKAAHIVWKCMKFLAKRGDLLGRLQS

SEQ ID NO: 375 - protein, 52 aa, synthetic construct
YWKLWNRFLRKFNKRARLPLKKDMKAKRHDRLLDELTARAGAHKHSHYLALV

SEQ ID NO: 376 - protein, 82 aa, synthetic construct
KFRLLCRFMKRFKRKCTNWYKESAALMRTAKLFPKARRKLATFRRLGHKVAANGGLKPHLCRRRASNRLVAAPVCAAHMQRR

SEQ ID NO: 377 - protein, 60 aa, synthetic construct
LYKLFNKLLRMLKKMRLCYKCDVPARHLRQRGTSKTALFKSRLKETRKAALRSAWLYCRQ

SEQ ID NO: 378 - protein, 71 aa, synthetic construct
RLKLLQRWIRRMRKARHDCLFLKAEAPLDRTSTRAAACWELAKWKNNYCAAYKARKNAQVGKSAAAIAQNR

SEQ ID NO: 379 - protein, 21 aa, synthetic construct
RLKYWSKLFKFYKRYAKAYAI

SEQ ID NO: 380 - protein, 46 aa, synthetic construct
ILKFLKKIIKKLNTVLAAGRLKRAKKAKAKIKLLAVKCFDRNKSNA

SEQ ID NO: 381 - protein, 41 aa, synthetic construct
RLKMFTKLYRRMKNLDPKCKAACRVIHAAKRHALARYLAFK

SEQ ID NO: 382 - protein, 41 aa, synthetic construct
FFKFFRKLFRLLRKIAEANELAGKGRKWALRWARSKRKAGG

SEQ ID NO: 383 - protein, 38 aa, synthetic construct
KWRYMRKILRFLHNQRAFLWLILFHALGRKWKGKAARK

SEQ ID NO: 384 - protein, 22 aa, synthetic construct
LLRLLQRYMKRLKKDGAITIMK

SEQ ID NO: 385 - protein, 61 aa, synthetic construct
KLKFLRRFLKFFPKQLKDLASNYRLLRKTHDRELLKIPFCQALKSANYKKRKKEKVKWQAL

SEQ ID NO: 386 - protein, 36 aa, synthetic construct
IMRYYKRLFKILRKRRKALLKRHKAAYLSAAAQLHC

SEQ ID NO: 387 - protein, 35 aa, synthetic construct
FLRYMKRLWKFMRQIDWDSARAKHKLKLMLAVKLK

SEQ ID NO: 388 - protein, 31 aa, synthetic construct
LIKYYRKFLKKFKRDRITQLGVALLLAAEIA

SEQ ID NO: 389 - protein, 54 aa, synthetic construct
FYRFMKRLLKRYRKDAKLSLRFRLRALEAMYAHVARRPIATTATKACAVTKFLA

SEQ ID NO: 390 - protein, 37 aa, synthetic construct
WFKILKKFIRLLHPRRRIARATNAQLMGIAKEARLLY

SEQ ID NO: 391 - protein, 27 aa, synthetic construct
KLKLFTRFYKILKQDSLAWKRFMLLAR

SEQ ID NO: 392 - protein, 55 aa, synthetic construct
LFRFLPKMLRLYTKPRSDALGAGTYKLLKRTKHFYASLGCAKLAARQLLFRKTLP

SEQ ID NO: 393 - protein, 77 aa, synthetic construct
ILRFIRRFLKKFSRTRVRGRLDAHALLAWLRYELSKQTRRGQYRLRIFKAHQFRCPKKKLLFFRPARQKAMKSLTLR

SEQ ID NO: 394 - protein, 37 aa, synthetic construct
KIKYLTRLFKKFKQAAKNFKARTYALKAACNRPAPNM

SEQ ID NO: 395 - protein, 55 aa, synthetic construct
RMKLFKKLLKRFKPLFSWRGLCAARRLASTICILKRLCNRQGGAAWKAKRARRSP

SEQ ID NO: 396 - protein, 39 aa, synthetic construct
LLRILSRLLRKFRKDKIRLSVKRLQLRALVKDVEAGRAQ

SEQ ID NO: 397 - protein, 32 aa, synthetic construct
RLRMFKRYLRKIKRLRALKDHAMLYTARMPSA

SEQ ID NO: 398 - protein, 55 aa, synthetic construct
RFRYIKRLWRLLKKHSIKKLATMLCAEKPDKLWGLRKSEGLLAALMCLTDELLIA

SEQ ID NO: 399 - protein, 53 aa, synthetic construct
RLKLFKRLLRLLQRLSWAQRRAALKPQCRISTMTAQDKRLPPAFKICDRAAAT

SEQ ID NO: 400 - protein, 24 aa, synthetic construct
RYKLITRFLKKFCSHKLAIALRSK

SEQ ID NO: 401 - protein, 42 aa, synthetic construct
RLKFMKKLLKFYRRRKAKQLLAWEQCLIMVRDRILLPRRLLY

SEQ ID NO: 402 - protein, 49 aa, synthetic construct
FWRLLKRFIRYLTSMYEAIARRKAKRAERLMIARLKELLSIWRKHEWRK

SEQ ID NO: 403 - protein, 65 aa, synthetic construct
LLKYWKKFYRIITRSCRAGKWRKPHARLYFLAALKAQWAWRKMRLILGLKELAGRMEAMSGSARR

SEQ ID NO: 404 - protein, 25 aa, synthetic construct
FLRLIKRLLRMLTRRAARIRTYGHE

SEQ ID NO: 405 - protein, 28 aa, synthetic construct
LIKLFKRILKMLKTNAHLAKRVLSKFSC

SEQ ID NO: 406 - protein, 24 aa, synthetic construct
LFRIIQKYLRRLCRLAQRRSAHPR

SEQ ID NO: 407 - protein, 47 aa, synthetic construct
RIKLMRRFYKRLSKESAFVHMLVRLAKRLLAMLTDWLVGRAKAADTC

SEQ ID NO: 408 - protein, 29 aa, synthetic construct
KMKLLTRLMKFFRNAWFKHYKALLAFARY

SEQ ID NO: 409 - protein, 41 aa, synthetic construct
RFKLYKRLYRKFTTKIKRTAMKAHLVDRSLVCFLLRDRAAA

SEQ ID NO: 410 - protein, 33 aa, synthetic construct
KYRFLRKLLRIFKKCWDKSGAAIVKAHRAAAWH

SEQ ID NO: 411 - protein, 24 aa, synthetic construct
KFKWYTRLLRKLKPWHADARKAMW

SEQ ID NO: 412 - protein, 25 aa, synthetic construct
IMKFWKRFLKRMTPHALAMAHAARA

SEQ ID NO: 413 - protein, 75 aa, synthetic construct
KMRLWKKFYKILQCDYLSNRLKREYCALLLQKKMAGALAPRRWLPLKLVSKVSAQKDLQRRADDKGRSLALRSLD

SEQ ID NO: 414 - protein, 27 aa, synthetic construct
LLRIFNKMLRRMKHRHLYCRWAYRLAY

SEQ ID NO: 415 - protein, 21 aa, synthetic construct
LLRLFKRLWRRMRPLADRIIA

SEQ ID NO: 416 - protein, 20 aa, synthetic construct
RLKLWPKYLKRWHKMFTKAA

SEQ ID NO: 417 - protein, 27 aa, synthetic construct
LMKMLSKFLRKWKPLLTAFYKGEWLKL

SEQ ID NO: 418 - protein, 30 aa, synthetic construct
LFKLIRRYFKKWRTVCFKAHRAELALKRSW

SEQ ID NO: 419 - protein, 46 aa, synthetic construct
MLRIYCRFFKLFRPTCLRRKLQKKLQCKSSGRKARALARCAACLNG

SEQ ID NO: 420 - protein, 22 aa, synthetic construct
RIRLYCRLLRRLSKLKCRLLYK

SEQ ID NO: 421 - protein, 82 aa, synthetic construct
KLRYLCRFMRKYRRAKHLTEARAWTKMLARLLRRKLTSHHGLNLSSRTLKAKARTETKKAKCLRLNNYGRELGSDVKRYFCR

SEQ ID NO: 422 - protein, 48 aa, synthetic construct
KFKLMRKLFKKFKQAVLTGTLKGKKLALNWLQCEYRLCKTRFLLKRVT

SEQ ID NO: 423 - protein, 30 aa, synthetic construct
LMRLYKKLFRRMKKAKLKFCFVKDPNGALC

SEQ ID NO: 424 - protein, 41 aa, synthetic construct
KMKLFPRLFKFFCRLAKSCCHRARRFEAKLAAREQNKRPYL

SEQ ID NO: 425 - protein, 34 aa, synthetic construct
WFRFLKKYLRKLRHFFCFKKMAMSVALTRLRAKL

SEQ ID NO: 426 - protein, 58 aa, synthetic construct
ILKLFPRLLRLLHQKKWYKEALKLKWKAKVMKRWRYFAHDAKMAARNNNPKMSKMLYK

SEQ ID NO: 427 - protein, 21 aa, synthetic construct
KIKYLKKLMRKLKNWAVAQQF

SEQ ID NO: 428 - protein, 31 aa, synthetic construct
KMRLFKKLMRRLNQRRGRCRYLTRAAAKALS

SEQ ID NO: 429 - protein, 25 aa, synthetic construct
MLKFWRKYLRRLRRTDWERLLWASV

SEQ ID NO: 430 - protein, 27 aa, synthetic construct
MLRLLKKLLKKLPKNAETKGMKGTDQP

SEQ ID NO: 431 - protein, 24 aa, synthetic construct
KYRMLRKLIRKICPLKTALLKARH

SEQ ID NO: 432 - protein, 33 aa, synthetic construct
LYRWYKRWWKFLSCYSHWKLKGLLAKDAKKLAR

SEQ ID NO: 433 - protein, 40 aa, synthetic construct
RLKLLKKLIRKWKHLWKHRESDMAFDAYLHSSAWKLTLGR

SEQ ID NO: 434 - protein, 27 aa, synthetic construct
KFKIWKRIFKRINHLTLAASLPAAVRK

SEQ ID NO: 435 - protein, 67 aa, synthetic construct
KFRLLPKLLKKISKKYYAIRVACAAELWLLAQRPLPDKQSKRNRRTAKACFSYKDAYDAAKDRWFGR

SEQ ID NO: 436 - protein, 34 aa, synthetic construct
KMKLLNRLLKKWRKAVVVAMDASWWVKRLNYEKK

SEQ ID NO: 437 - protein, 52 aa, synthetic construct
IWRMIKRMLRLYKRHAANPRKLWKLITLAVQAAHQLVLALFRFQRRHRWALK

SEQ ID NO: 438 - protein, 39 aa, synthetic construct
YFRFFRKMLKRWKPRALNALTAARRRKLCYRPEAQAILK

SEQ ID NO: 439 - protein, 20 aa, synthetic construct
KLKFIRKWLRKFQKLIDPLA

SEQ ID NO: 440 - protein, 45 aa, synthetic construct
LFKWMKKLLRIWNKNRRLARLAMQNPPARLTKRACKIKQLNRAQY

SEQ ID NO: 441 - protein, 23 aa, synthetic construct
RIKFLRRLMRKLRCNLDTLLAAE

SEQ ID NO: 442 - protein, 41 aa, synthetic construct
RLRLWHKYWRKLRSLAKECQFCFKLAAAAKDPTRPERRIRK

SEQ ID NO: 443 - protein, 46 aa, synthetic construct
RFKLLCKLFRKMRKRATSKTAAAMLKLKRDYIWAGFTAPDIASLRL

SEQ ID NO: 444 - protein, 46 aa, synthetic construct
LLRMMHRWLKKLSRWLLTTKARLMPCIDTPLKYRALTDAARVASKR

SEQ ID NO: 445 - protein, 41 aa, synthetic construct
LWRFFQKFLRLFHRMRGGLARLRQKALILHLRTDRKAYALR

SEQ ID NO: 446 - protein, 36 aa, synthetic construct
FMRLLKKLLRFFHRWKKLLLMLKLCKEARAFAMDPS

SEQ ID NO: 447 - protein, 50 aa, synthetic construct
LFKWFKRLLKRYRRRDRKYHSTKLRLASWDFALSCLRRKGHAEHTSAVKA

SEQ ID NO: 448 - protein, 22 aa, synthetic construct
RLKFLRKFYKRLHRLYFAAWLR

SEQ ID NO: 449 - protein, 67 aa, synthetic construct
KLRMLHKFFRYIRQKPAYYKLAERFHPSLVHAEPARYKAAKKADLNADKQRVKLAEQKDKACVARLA

SEQ ID NO: 450 - protein, 32 aa, synthetic construct
KMKFIKKMLKLLRRAKLWRPPLVDTPQGRLLE

SEQ ID NO: 451 - protein, 49 aa, synthetic construct
LWRFLNKMLKMLSRLRARRRQRCDLQMLWHLLQLKAQTKAKTFWHTGAA

SEQ ID NO: 452 - protein, 85 aa, synthetic construct
RFKLMPRLMKRIQKRKACIYAKMWFLAHVTMDAARRLAMRVKYFPLHDHKLSSKCARPIKCHRILEAKQLKALYRRLKRLTANKR

SEQ ID NO: 453 - protein, 24 aa, synthetic construct
LLKLLNKMLKIYTTRMQAVAAIRR

SEQ ID NO: 454 - protein, 28 aa, synthetic construct
RLRFFKKFLRKMKRKADALAQILYASHD

SEQ ID NO: 455 - protein, 40 aa, synthetic construct
RFKFLKRWLKRLQKLAQLLVQKDAGQQSPRWLKHGLSARP

SEQ ID NO: 456 - protein, 57 aa, synthetic construct
LLRWLNRLFKRLKCCKRSYYFRELKRLDRARILPRTRRVILRALHMPFCAWKDIGAR

SEQ ID NO: 457 - protein, 39 aa, synthetic construct
LWRFLRRLMRFLKRTGLFQRNNLLFAKHKPRARNFRLLI

SEQ ID NO: 458 - protein, 56 aa, synthetic construct
FFRMIKRFLKMLKQLAEWKRNGAFKAAAKALREKTKAPYRARTARLKHCRIRRVRL

SEQ ID NO: 459 - protein, 38 aa, synthetic construct
LIRLYRRFFKIFRKRAKLVGCYAASLHFTEPRLRRKLF

SEQ ID NO: 460 - protein, 21 aa, synthetic construct
MLKLLRKWMRRMQNLAYKCLT

SEQ ID NO: 461 - protein, 30 aa, synthetic construct
RLRMLRRLFRRLSRVCRLERATAQHPYLQR

SEQ ID NO: 462 - protein, 21 aa, synthetic construct
FWRLFNRLFKKFKTANRCKAA

SEQ ID NO: 463 - protein, 42 aa, synthetic construct
FLKLYPKILRLLRTAENPALLDALLDIRKNKIQNKRRTKRCK

SEQ ID NO: 464 - protein, 69 aa, synthetic construct
FMRLLTRWYKWLRNYSLKAEGRLRRQPAKMLDKCWKLNTRRHIHKSRAWKRLVRAYLKLHPHKATAAKY

SEQ ID NO: 465 - protein, 37 aa, synthetic construct
RLRLLCKWFRKLKPLQLVLWTRALWRIKRAYNAICYF

SEQ ID NO: 466 - protein, 70 aa, synthetic construct
RLKYLKRFYRKFQCKKAMRHRATRLARAEPRDALPRLALPVTKLHAANEMFDERLCWRKKRKDFAMLKKM

SEQ ID NO: 467 - protein, 56 aa, synthetic construct
RLKLLCKWLRMMKTARASMAACLSMSWDVKANVGLRQRTGLKARKCELKKLACALA

SEQ ID NO: 468 - protein, 60 aa, synthetic construct
KFKMLNRYIKRLPRAPRLAKKLAEFVMDRTLETDNAKKYGMTLLLSDCNAALDGLALLRK

SEQ ID NO: 469 - protein, 35 aa, synthetic construct
RLRLIRRFFRWFRKRTLPLRDHFKLMYARAWAAYA

SEQ ID NO: 470 - protein, 71 aa, synthetic construct
RLRMYKRMWRKLRKCDSAYFLKYWNKKPLKVKRAWLATWAANLAIQPVCAKCRRDGNMKRRWLMAKLIRRL

SEQ ID NO: 471 - protein, 44 aa, synthetic construct
RLKFIKRFWKRYHRMPRIAALRDFKANAFAAHKKRLKMGDFCAA

SEQ ID NO: 472 - protein, 37 aa, synthetic construct
RMKLMCRYLRRLCCTIKKTLLLDLCREANLLATLAKK

SEQ ID NO: 473 - protein, 34 aa, synthetic construct
RFRYWQKLFRRLRREAAVNMATLLSAGMEKLEAA

SEQ ID NO: 474 - protein, 28 aa, synthetic construct
YLRLMRKLMRFLRSEKACTWKAHKKALA

SEQ ID NO: 475 - protein, 56 aa, synthetic construct
FFRLLKKMLRILSKALLPKESKKIKDNETLRSRCQLAVLRRALDSKFWRAYLLNTR

SEQ ID NO: 476 - protein, 26 aa, synthetic construct
RFRFIRKLLRRLKQWDLNLQPLFLNA

SEQ ID NO: 477 - protein, 33 aa, synthetic construct
KFRLIKKLLRLLRRDKALNVQILMCRSEFRDAR

SEQ ID NO: 478 - protein, 42 aa, synthetic construct
KYKYYRRFIRKLHHVKKLRDEHDAAVRALPKLLAQRLWARAW

SEQ ID NO: 479 - protein, 45 aa, synthetic construct
RIRFLKRILRRWRHLCILHALAAHKPPTLAYKWKVWPKAYDLLKK

SEQ ID NO: 480 - protein, 62 aa, synthetic construct
KYKLFPRFLKFLQNRSHLWNERDALAAKPVKWRKKEALVWEQGANLRLDRKKAWAARQCKKK

SEQ ID NO: 481 - protein, 67 aa, synthetic construct
FMKIICKFMKWFKNKLVLMLLLIRESIPAGYLDFKFAYLMKLARKHPKRRRLFRRKLKAFAAMKAAD

SEQ ID NO: 482 - protein, 30 aa, synthetic construct
RLRLFKKYIKKWRKAFCVAFRGALLLRKSL

SEQ ID NO: 483 - protein, 55 aa, synthetic construct
LYRLLCRWMRRLKPKDHADEALLIKQKDKNKKCFALVLKLLLSHLKGKHPDVAGR

SEQ ID NO: 484 - protein, 20 aa, synthetic construct
KWKLYHKILRRWKTAAAEEL

SEQ ID NO: 485 - protein, 21 aa, synthetic construct
RIRLLQRIFKLFCRGRRATLV

SEQ ID NO: 486 - protein, 36 aa, synthetic construct
RWRMWHRLWRYLKCLVKRQRKNWLALAKAKRWQEDA

SEQ ID NO: 487 - protein, 38 aa, synthetic construct
IYRLIQKLMKRLQHLSNKLQRKLAKARLAAAICARKIY

SEQ ID NO: 488 - protein, 46 aa, synthetic construct
YLRLLKKLYRLLRPAKEMKKLTLRKLKRIYKIKPNRALTMLSSKRD

SEQ ID NO: 489 - protein, 69 aa, synthetic construct
LIKFFKKMLRKLRPFQRLAKRRLLAASNKFEAELIWSKHDKLDGPKKRGRHMYKLLMVRRSQLSKIASA

SEQ ID NO: 490 - protein, 30 aa, synthetic construct
RLKLLKRLMRLYKHLQWQLACYRMKYYKPT

SEQ ID NO: 491 - protein, 63 aa, synthetic construct
MLKWWQRFLKLIHKRQLKALDARIKWCNRLRARAACGAYRAALQPELRQVMAEDAFWMAARRE

SEQ ID NO: 492 - protein, 23 aa, synthetic construct
KFKYYRKLFRRLSRAKARELALQ

SEQ ID NO: 493 - protein, 36 aa, synthetic construct
LLRIWKKFMKLFCKHQELAERAKSTRKMRYVLAMRL

SEQ ID NO: 494 - protein, 32 aa, synthetic construct
IIRLFRKLLRRLCRHARPVKRTANVELKLKMS

SEQ ID NO: 495 - protein, 34 aa, synthetic construct
FFRLLRRYFKLFKRRMSTLKKVAMSTAANLLAQL

SEQ ID NO: 496 - protein, 22 aa, synthetic construct
LFKYYRRIFKLLKNANQRGAKL

SEQ ID NO: 497 - protein, 36 aa, synthetic construct
LYRMWKRLIRKLHRQDKKWALGARVDAKKMCGEALK

SEQ ID NO: 498 - protein, 20 aa, synthetic construct
RFKYYSRLYRFLRRLLNLIQ

SEQ ID NO: 499 - protein, 24 aa, synthetic construct
RMRLYKRLWRFLKPHLPAMLERLV

SEQ ID NO: 500 - protein, 55 aa, synthetic construct
LYRFFKRLIRRLPTWMLCMVAAYLLLRRRRSCKFIKARLPDLSAMSPRLKRLDAR

SEQ ID NO: 501 - protein, 40 aa, synthetic construct
KIRFLKRLIKKFNTVSAGLLLKRYKLLLGMPKAQRLLAAM

SEQ ID NO: 502 - protein, 27 aa, synthetic construct
RIRFLTRWFKLIKRKLLALLLQAQWYH

SEQ ID NO: 503 - protein, 35 aa, synthetic construct
KLRLYKKYLRFMRKFARDLLAKEFKLSRNNALCMF

SEQ ID NO: 504 - protein, 58 aa, synthetic construct
KFKFLSRFLKRLRRNMAIAAFLMMKSAGMRYKAECKWKCLDERMLRMALSAAPYRKLR

SEQ ID NO: 505 - protein, 44 aa, synthetic construct
LLRFLNRLFKRIRKEAAQLYKRLYIKKKRPQKAHLEGYRDMGWL

SEQ ID NO: 506 - protein, 26 aa, synthetic construct
KYKFFQKMFKRLQKARLELRRRLAAL

SEQ ID NO: 507 - protein, 24 aa, synthetic construct
KWRYLCRMFRKLCSRLHRPALATL

SEQ ID NO: 508 - protein, 62 aa, synthetic construct
LLKLFRKILKRLRSIKKAAVHCAIATLEASARRAEANAWKNTSTAATEKARLRVMKLLEAKW

SEQ ID NO: 509 - protein, 52 aa, synthetic construct
LYKLLRKILRKFKKYLAMPRFHAGARADPLRLKRRSPGLQFSEKKRMLTTMY

SEQ ID NO: 510 - protein, 57 aa, synthetic construct
FLRILKRLYRFIRRAANWKKLQLLAMADTRAVRWCRAVRFPVCAIKPKKRARKQMFE

SEQ ID NO: 511 - protein, 26 aa, synthetic construct
LLKFLRRFLRFYKCPNLAKKESKKWA

SEQ ID NO: 512 - protein, 31 aa, synthetic construct
KMKFLRKLYRRWKRILAAMVKLLTLKCQGLQ

SEQ ID NO: 513 - protein, 74 aa, synthetic construct
RFKIFNRMLKRFRNALKAAKFEAWMHLLRLRQWNLHADTIKAFRLTLRPKDALPQELRKLGTSQLKRAQAALKM

SEQ ID NO: 514 - protein, 46 aa, synthetic construct
RFKMLRRLLRMLNPNAALTRSLTQKWQAALQRKALRRKPRRDYIPP

SEQ ID NO: 515 - protein, 46 aa, synthetic construct
RYRWMQRIFKYLRSAKLTCHYRLKAPKVDCRYLALKLQLRLPAALD

SEQ ID NO: 516 - protein, 27 aa, synthetic construct
MYKMLKKFIKRLHPKLHLWLKFKALVR

SEQ ID NO: 517 - protein, 44 aa, synthetic construct
KLRWICRLLRRMRNLNIDMAIVRLLATVKSDKRYIKTKARKARA

SEQ ID NO: 518 - protein, 34 aa, synthetic construct
LLRMYRKLYRKWKRLAHKLKMAPCNWLVCHRAVC

SEQ ID NO: 519 - protein, 37 aa, synthetic construct
RFRLFSRFWKRLTSSWLLAKCAARKAVLYGVRLAARW

SEQ ID NO: 520 - protein, 54 aa, synthetic construct
KLRFLQRFYKLIKRAWRLKALGLLKRCPGAPEKDRLEIVARLLVALCFRHKAPL

SEQ ID NO: 521 - protein, 43 aa, synthetic construct
RMKFLRRILRKYHPTQDRRASNSRATSHRDLLLLLKACLCAYR

SEQ ID NO: 522 - protein, 57 aa, synthetic construct
KLKFLCRFIRRWTRFLPQKYAYDAALANEARAPAMQARRNKQLVKNKWAATEYRARL

SEQ ID NO: 523 - protein, 92 aa, synthetic construct
LWKYYRRMLRKFKCRELKLAWDQLWPRCKRPYAVTKIVKEQSRGAAVLIANALLKPLLLCGLARKYRADACQKHRGRTLDRHKLARLEAPEA

SEQ ID NO: 524 - protein, 31 aa, synthetic construct
RLKLLKRYFRLLKKKTGRVWAWKYACHANNH

SEQ ID NO: 525 - protein, 40 aa, synthetic construct
LFRLLKKLLRWMTRQKKAAKPADKLLKLFLDKGVHNRILI

SEQ ID NO: 526 - protein, 24 aa, synthetic construct
RFKLMRRLIRLMKNCNKAHREATA

SEQ ID NO: 527 - protein, 23 aa, synthetic construct
RMKIFKRLLKRFSPLILRLSCAY

SEQ ID NO: 528 - protein, 45 aa, synthetic construct
LMRLYHKLFRKFKPTLRADKKNARPKAMRYMSDLCYLFARWRLKK

SEQ ID NO: 529 - protein, 50 aa, synthetic construct
FIRWYTKLWRFLRREAKPREALHEKKAANRARISACKACADHKRKFAKAM

SEQ ID NO: 530 - protein, 22 aa, synthetic construct
LFRWLRRYLRRYTHAYLRCLLH

SEQ ID NO: 531 - protein, 32 aa, synthetic construct
LLRFMKKLYKRLKKLRNILKASSLDKLLPLEH

SEQ ID NO: 532 - protein, 42 aa, synthetic construct
KYRLLKKILRKFQPARNKFRKLGCLRQASRYELALAMYTRIW

SEQ ID NO: 533 - protein, 58 aa, synthetic construct
RLKFLRKMIRRIPRAALKYMCAEWGKKLAGAITLAGLKKYHIALFHADKKAPKLYCNL

SEQ ID NO: 534 - protein, 20 aa, synthetic construct
RFRMWNKILKLWRKWALAAE

SEQ ID NO: 535 - protein, 37 aa, synthetic construct
LLRMWKKYMRKWKCLACHAFIHLSTLLLRLMARVRAT

SEQ ID NO: 536 - protein, 21 aa, synthetic construct
KFKYLPKMWRFMSKALKLLNL

SEQ ID NO: 537 - protein, 21 aa, synthetic construct
RMRWWNRLFRKFKPIAAALLS

SEQ ID NO: 538 - protein, 21 aa, synthetic construct
LFRLFTRWLRWLPRVLKQRGK

SEQ ID NO: 539 - protein, 26 aa, synthetic construct
KLRLLSKLFKRLCRPLLKQALYDKAK

SEQ ID NO: 540 - protein, 34 aa, synthetic construct
MLRLLKKFLKKWPSASLLRYCFLYFFAAKFRARR

SEQ ID NO: 541 - protein, 45 aa, synthetic construct
YLRLWRKWLRKWKKDRGMLKWAEQGAAIGCLYLKEDAKLWPLKLF

SEQ ID NO: 542 - protein, 78 aa, synthetic construct
KLRWLTKLWRRFNRLKQALQRFNLLLQYWRRTAKVAKLGKWREDAIYLQKIALSKNKAARTAKCSHAGWSKKKWIAIS

SEQ ID NO: 543 - protein, 70 aa, synthetic construct
KWKIICRWMRRFRRAAAKTKRWAAKKNAGPAKYKRHEVYRLKKWEALHKVDFKCLWWRRSLAASTTRATL

SEQ ID NO: 544 - protein, 32 aa, synthetic construct
FLRFLHRLLRKLHRKTKALRRELKAGAHKLFS

SEQ ID NO: 545 - protein, 40 aa, synthetic construct
LLRMLPKYLKLFRSRHRFKCIALRRDKGDYMDVLRRHLYK

SEQ ID NO: 546 - protein, 66 aa, synthetic construct
LLRMLQKFFRRLTQTKLRPSARLRGKARLRQLLMRMEKRRVLGGLYLFKVPLLNMAILNKCGRKQP

SEQ ID NO: 547 - protein, 20 aa, synthetic construct
RIKYWHRFLKFLSPLLARGR

SEQ ID NO: 548 - protein, 76 aa, synthetic construct
WYRLMTKLLRLLKQLFIKNKKNLFAFRLPMSRMLKTICWDGAMKKLLAMKMKGCATKVRKARFTWLNDKALLTLKK

SEQ ID NO: 549 - protein, 77 aa, synthetic construct
KLKLIKKLLRRMRNRLRANCRVISALCTDWLCKWAKSEICDLCTLWLKRHKAKAKRANAKALLSAKLCKTAANMAAC

SEQ ID NO: 550 - protein, 43 aa, synthetic construct
IFRMLCKFMRKLSRAALKMLTRGVCLAIPVLKIKYKQKKNLAA

SEQ ID NO: 551 - protein, 28 aa, synthetic construct
LFRLLCRLLKRLRQGAPSKRPDADILKY

SEQ ID NO: 552 - protein, 24 aa, synthetic construct
FLRMMTKFWKFLRTKAAQLRRGAR

SEQ ID NO: 553 - protein, 24 aa, synthetic construct
YLRLFSKFFKRLKRAAFHFAQKLR

SEQ ID NO: 554 - protein, 38 aa, synthetic construct
LWKLWRRLMRLLKSNRGYPVKLLEALGARKLSKVAEFD

SEQ ID NO: 555 - protein, 34 aa, synthetic construct
RFRLMKRFFKILKKHYKLVHFARDAAQTAQYKAR

SEQ ID NO: 556 - protein, 24 aa, synthetic construct
FYKLYRRLLRKWRTYAKLLVRHNL

SEQ ID NO: 557 - protein, 27 aa, synthetic construct
LYRLMTRMLRKFQKRAGWDGMLTARRL

SEQ ID NO: 558 - protein, 47 aa, synthetic construct
KLRMLRKFLRMLKRRAVGWKIPARQLLRFPIFAGRLYLYLSKCTARP

SEQ ID NO: 559 - protein, 60 aa, synthetic construct
RYKILKKILRRIRHVRMLYAELDFLAHQLAGMWNIKLHWRARANYAPGRAKKLFGLRLLA

SEQ ID NO: 560 - protein, 30 aa, synthetic construct
IMRIYKKLWKFLKRLPALRRNQLYYLLTAR

SEQ ID NO: 561 - protein, 21 aa, synthetic construct
RMRLMCRYYRLLHRRNAAKDD

SEQ ID NO: 562 - protein, 50 aa, synthetic construct
RFKLFQKWWKMFPCAARYKARKAAMRHLIRLILAERKAAVLHAMVDKKLQ

SEQ ID NO: 563 - protein, 75 aa, synthetic construct
KLKMLQKMLKKMTKGCLLVAYNLLKRATVVATAKLRLYKKLRIAFNGKKKCLKLKVKMNMSCKAFRNKAKKKYAD

SEQ ID NO: 564 - protein, 64 aa, synthetic construct
LFRLLPRYMRLLKPAMDKKALQAAWGRLEEHEQLLKGKYLRRIKLTLKNCKAWTKWFRLACPKC

SEQ ID NO: 565 - protein, 36 aa, synthetic construct
YIRMIRKILRLFQQLRLYQLRMRRAKKHAHLLAEHW

SEQ ID NO: 566 - protein, 55 aa, synthetic construct
IMKLWRKFLKYYRCQPHKVLFRRRYLRLWSATLRRQRKLRMTARKAAITLRWLHA

SEQ ID NO: 567 - protein, 76 aa, synthetic construct
RLRMLRRFMKRIKKRHSLLKLECRLAAAKSAWKLLCKELDSAIVAMVRKFPTARLKAYTKKRFDGQKLRHVRVNLL

SEQ ID NO: 568 - protein, 28 aa, synthetic construct
RMRLWKRMFKLLPKRLLGAGDKAGSAPR

SEQ ID NO: 569 - protein, 28 aa, synthetic construct
LYKLLQRLFKLYQRRKRDLAGKLRLIWK

SEQ ID NO: 570 - protein, 21 aa, synthetic construct
KLRFLCRLMKFYKRAAKAMSL

SEQ ID NO: 571 - protein, 61 aa, synthetic construct
RLKYFKRIWKRLKRPYWGEKSPAAHLQYLNAGKRLKGREATACVALLTRKQYAVLAAVRCR

SEQ ID NO: 572 - protein, 33 aa, synthetic construct
IMKWLKRWYKYFRRKALAKMTARSLACYRADTK

SEQ ID NO: 573 - protein, 55 aa, synthetic construct
IIRLYHKMIRYLRCVKFRSLVTKRPLLNGAAKLQRFHTTKVARHKLAKKLKKRWL

SEQ ID NO: 574 - protein, 87 aa, synthetic construct
KYKFFRRLLRKMHKVKRMLQPMWLWLQRKAYGRLLGARGCRAVRCRMRLHDKRSHCKAYPLAGRKATRLRTHNKLSHHERRLGTALR

SEQ ID NO: 575 - protein, 24 aa, synthetic construct
FLKFLTKYFRKFSKKAPIRARLEL

SEQ ID NO: 576 - protein, 43 aa, synthetic construct
RLKMLPRLFRKYNKLHRKSNVIHKAMDRLHLKVRTLAKPKLLR

SEQ ID NO: 577 - protein, 30 aa, synthetic construct
FFRWMSRLLRRIKRDAYMKLTPSLLLKLRY

SEQ ID NO: 578 - protein, 35 aa, synthetic construct
RLKFLHRWLRRYNCWLTITALARRPRLKQARVWAH

SEQ ID NO: 579 - protein, 31 aa, synthetic construct
LFKLICRLLKRYSRMRYRLCRCRKYCMLAIA

SEQ ID NO: 580 - protein, 37 aa, synthetic construct
YMRFFTRLWRWFSRLGAKSARAYARLRLMRMILRRFR

SEQ ID NO: 581 - protein, 58 aa, synthetic construct
RLRFYRRLMRKLQRDLRRRKLSKSAFFQLRISEKLAYFVFKTLRLARYSVRLPQPLLA

SEQ ID NO: 582 - protein, 22 aa, synthetic construct
LYKIIRKLLRRLPRAIMDMLKA

SEQ ID NO: 583 - protein, 71 aa, synthetic construct
RLRIYRRIWRKIKTLLVKLRESDAKLAKKARANAFRADYELMRRNTVKGSKLALRNRKVVRLFRLGWALET

SEQ ID NO: 584 - protein, 83 aa, synthetic construct
KFRLLHKLYKRLNKERKKRHIRGETLMLYNKTALPRRCLLRFAFGRRNRAAPTRQQVRKHYGKAAAHKLKLLRSEIAAIKLAP

SEQ ID NO: 585 - protein, 44 aa, synthetic construct
KLKLYRKWLRLFTQLRKLGKFLPRHDAWARRVMGANQLWYMLLA

SEQ ID NO: 586 - protein, 45 aa, synthetic construct
KLRLIKRYMRKWKHLLKCQLNRMCLFRLERKAQKRVILLVHMELW

SEQ ID NO: 587 - protein, 84 aa, synthetic construct
RLKLYPRFWKMMPKLPRLKAVARMLKKKKRLWLLSQYLGLPEPKMRGMHEDKAAIADKVLYRLLKDSLLYAVLLLPLIHLANKK

SEQ ID NO: 588 - protein, 24 aa, synthetic construct
KYRWFKKMFRLFTRAMLLEALYLR

SEQ ID NO: 589 - protein, 20 aa, synthetic construct
RMKLWHRLYKRWQTIKLLAL

SEQ ID NO: 590 - protein, 49 aa, synthetic construct
MLRLFKRLLRFFTRLLERLFQLRKKSRATDKKKRAPEFALCLYELHYRY

SEQ ID NO: 591 - protein, 49 aa, synthetic construct
FWKYMNRLLRLMTRNLASLNSAEAPKPLCKLINARRIKEALARLKWKQW

SEQ ID NO: 592 - protein, 46 aa, synthetic construct
LLKLMRKFLKLLSNKPIRLLKLVSRRDIWMVKLRLANGQAWLYKIW

SEQ ID NO: 593 - protein, 29 aa, synthetic construct
WLKILTKYMKILRRDAKVDLLLKKKRLYL

SEQ ID NO: 594 - protein, 27 aa, synthetic construct
YFKILRKLIKWLRRGLDLKLKAVLYRP

SEQ ID NO: 595 - protein, 42 aa, synthetic construct
YLRLFRRYYKFMKSYREARLKIALIRRQMCLAATAYLAKTDR

SEQ ID NO: 596 - protein, 49 aa, synthetic construct
RFRYLNKLWRKWTHRNRKANLRWRFDQALRLILPQADMKAKLDAARVRD

SEQ ID NO: 597 - protein, 44 aa, synthetic construct
KLRFLRKLFRKLSRYVWNCRAIVPAWYTKKELEKLKLANLLTRY

SEQ ID NO: 598 - protein, 99 aa, synthetic construct
RYRLLKRMIRKFRCAMRARKKAQLLKQVKNLKYQPIRADEFDRILMDFAPLRLTLRRRMINRDKALTRWLACGLYRVNAHMARVVWARLEAKQREGLRL

SEQ ID NO: 599 - protein, 61 aa, synthetic construct
YLRILRRLMRKLSRRACHYKELACILARCTLWLRWSVVRLAAKLIRFKKNRWDCLRILRLL

SEQ ID NO: 600 - protein, 27 aa, synthetic construct
KLKLYKRWWRYFSKAWFHRKLNACNLA

SEQ ID NO: 601 - protein, 30 aa, synthetic construct
KMRMLTRLFKRMRRSLRARMLDDALIAADL

SEQ ID NO: 602 - protein, 22 aa, synthetic construct
LLRIFCRMYRRFSRKYLLLRCA

SEQ ID NO: 603 - protein, 20 aa, synthetic construct
LIRMYRKFLRRLHNALYKIM

SEQ ID NO: 604 - protein, 33 aa, synthetic construct
WLRLMRKLLRKLKCKQWLQKHASVRLALLAIVG

SEQ ID NO: 605 - protein, 20 aa, synthetic construct
YLRMLRKLLKRMHQAAFNLS

SEQ ID NO: 606 - protein, 60 aa, synthetic construct
LLRLFQRLWRKLRNGKAKLGHLWKLDGKAQLYAVHMAEKTLRYHTRYPCFKAARRARRGY

SEQ ID NO: 607 - protein, 25 aa, synthetic construct
RMRFYSRYLKFLKNLALMLNAKKKD

SEQ ID NO: 608 - protein, 29 aa, synthetic construct
FLKLWCKLLRKLQQGKPYLRRRAAATCRQ

SEQ ID NO: 609 - protein, 100 aa, synthetic construct
LFRMITKYMKRLRRKVCMAGYRAKLNKNPKLERLLSAYAKQPVRMARGALAMRLEFDVEAYFLILKQLQYHAYRIAIARTKSEWRAAKKKSKRLRKDYAK

SEQ ID NO: 610 - protein, 30 aa, synthetic construct
RYKIWPRLLKILRRAWQRELKIFLPGNRLR

SEQ ID NO: 611 - protein, 65 aa, synthetic construct
KLKILRKWYRKLQHKAHNARHQRAYPELARATTSALCDKRRKRCSKRKIPARLLALNREHRQRES

SEQ ID NO: 612 - protein, 23 aa, synthetic construct
YLKYIKKLLKKLNSRLARAIRSL

SEQ ID NO: 613 - protein, 67 aa, synthetic construct
WYKLLRRYIRRFKTKEQLANKRCAKLDALRCRTRPEKRNKSEFLLDAIPHLALKVARRSPFRAMRQG

SEQ ID NO: 614 - protein, 36 aa, synthetic construct
RIRFLSRLLKKFRKDSTMYAQDARARLGALQKYRWS

SEQ ID NO: 615 - protein, 55 aa, synthetic construct
WLRLLRKLFRRMKKKEIARITKSLKRIQANFNTRAGAKIQRTQAATALCNNRILK

SEQ ID NO: 616 - protein, 48 aa, synthetic construct
FFRFWSRFFKKWKKLLLAALKASFVQRKCANAKMTRRCALARQKLKWD

SEQ ID NO: 617 - protein, 54 aa, synthetic construct
WLKWIKRFLRMLCTKIKKASAKAARKLAAVNWRKGDRLSSKKYAKQRNALAMRQ

SEQ ID NO: 618 - protein, 45 aa, synthetic construct
KIRMFKRILRYFHRAALVRHYAVDRVTKGCLLLLRALPKIWWKRA

SEQ ID NO: 619 - protein, 24 aa, synthetic construct
MLKLMRKMLRLLCHRVAKRDHIRY

SEQ ID NO: 620 - protein, 51 aa, synthetic construct
FIKFLRRWLKFMNNLCYYAMRKLLVKAFRKRLKILHRYIRNRRWLLLKLKT

SEQ ID NO: 621 - protein, 23 aa, synthetic construct
ILRFLCKILKRLKQNFLATLKCP

SEQ ID NO: 622 - protein, 26 aa, synthetic construct
MLKMFRRLWKRLNKFLARQKLLRWNY

SEQ ID NO: 623 - protein, 36 aa, synthetic construct
RLKFLRRLWKWLKCAPRRALPRAAKLTRCLENSLMK

SEQ ID NO: 624 - protein, 66 aa, synthetic construct
LFRMLPRMWRMFKQKDIFSDALKKKALKKLFQWEQRHALLRKSFLKALRRVFIHTRLRCRKASRAQ

SEQ ID NO: 625 - protein, 22 aa, synthetic construct
KWRFLCRYIKLMNKALLWAERL

SEQ ID NO: 626 - protein, 40 aa, synthetic construct
KFRFLRKMYRRLKKKIPYCQLQRNTMRQAAAVCAARLLKR

SEQ ID NO: 627 - protein, 63 aa, synthetic construct
RIKMLTKFIRMLSRLRAVRKFRLECCLQAQDWLFKDSTRAQIEMLAHKRARKKVRAAATARLP

SEQ ID NO: 628 - protein, 79 aa, synthetic construct
RYRLIKKWLKKFRPRLRAASRAKALKMGKLCAKRPAGQDLPRLWAMNHENRGYYNAGAYRAGKAFKRKAYKNKILARLR

SEQ ID NO: 629 - protein, 82 aa, synthetic construct
KLKLLQKIFKKFQRELGLRNKLALKAELNTSRRLLCFYTLLKKRIILKKKWGAQAWRLYDHRTMLRTRKLAVKKAADMLIAF

SEQ ID NO: 630 - protein, 23 aa, synthetic construct
KLKMFPRFLRKLSKAKAVDQACT

SEQ ID NO: 631 - protein, 26 aa, synthetic construct
RLKWIKRLFRRMRQAMIRNALCAARM

SEQ ID NO: 632 - protein, 43 aa, synthetic construct
FWRLLQRLLKRLTPALLPCSKRLVVHRGLTAKRRAADKHAPKC

SEQ ID NO: 633 - protein, 51 aa, synthetic construct
KLRIFKRMLKFIKKAAAAYCLAKAERSGRKKCLDGVAVPKPQGKANKPYKR

SEQ ID NO: 634 - protein, 32 aa, synthetic construct
LLRILPRFFRIFRNARWHQLRDLKLLLVEKAR

SEQ ID NO: 635 - protein, 36 aa, synthetic construct
FFRILTRLLRFWNREGARRAKTTALRSALDWRKGQR

SEQ ID NO: 636 - protein, 43 aa, synthetic construct
LYRLMKRLLRKMKCLNAKGMKFKGKCAIRALQKCAHRRARLHF

SEQ ID NO: 637 - protein, 50 aa, synthetic construct
LYKFYRRFWKRYQKRKYKADAHFAKRVALVALAPMKGKETLRSRAATGKC

SEQ ID NO: 638 - protein, 36 aa, synthetic construct
KLRLFKKMLKKFKCKAMLSANDMARQSVAKWLASAT

SEQ ID NO: 639 - protein, 39 aa, synthetic construct
RYKLFRKFYRKYPQNLAAARARVPRVRADCQLRKARTAL

SEQ ID NO: 640 - protein, 39 aa, synthetic construct
KMKIYKKLIKRLKKQKAAAQHIPRGLLLYLCKRLAGRRW

SEQ ID NO: 641 - protein, 25 aa, synthetic construct
FWRLFHKLFRKITRDLKLNAWARKN

SEQ ID NO: 642 - protein, 38 aa, synthetic construct
WLKWLCKFYKYYKCCRPRRRVLALKRLKMLRSLPQLQH

SEQ ID NO: 643 - protein, 27 aa, synthetic construct
RFKYLKRFLRLLRRGVVAGLKQILSIH

SEQ ID NO: 644 - protein, 49 aa, synthetic construct
LLRFFRKLLKRLSKGRTCNFFFPICNQLKNKKANRMAAAKALRRYRILF

SEQ ID NO: 645 - protein, 28 aa, synthetic construct
KMRFIKKWLRLICRSILRFRALLGGQRL

SEQ ID NO: 646 - protein, 72 aa, synthetic construct
MWRFFRKWYKKFKNPARRIKLALRSADVLQQLAFYDQRRKELTKDTLSRRVSRLAAARHLVRRLWQEEAKLL

SEQ ID NO: 647 - protein, 59 aa, synthetic construct
KLKFFTKILKKFPKRALLYTRTALKAHKERSYLRRVYKTDCLLRVKAKWNRLQNVYALC

SEQ ID NO: 648 - protein, 28 aa, synthetic construct
RLKLLRKLLKMIKKWADHKAPKEHMRCL

SEQ ID NO: 649 - protein, 26 aa, synthetic construct
KLKFLNKFLRRWKPLIANPLADKRMP

SEQ ID NO: 650 - protein, 72 aa, synthetic construct
YLKLFRKLIRKFKTRLVVFESNKLMAARYLRKKPVLLALHRLFLLRRDARHRELSPKRQLHIHRLQFPLMAR

SEQ ID NO: 651 - protein, 38 aa, synthetic construct
RMRMLPKLLRLLTKANKNKFYMMLKLARCFANRLGYAH

SEQ ID NO: 652 - protein, 40 aa, synthetic construct
WWKLWNKFYKRFKCRPALQDRCRKAFRKKVKLVAYLQLLA

SEQ ID NO: 653 - protein, 41 aa, synthetic construct
RLKFYTKFMRRWNRAIVERNAAPLTAAKDALQLALKLPHKG

SEQ ID NO: 654 - protein, 89 aa, synthetic construct
FLKIIKRFIRFMKTDLKRLKRSKYTVAKYIWVWVEEDARARKLAAHKHAALLSLRCARDARKYCKCYSGHKAKIEKKLDARAKLARRHD

SEQ ID NO: 655 - protein, 40 aa, synthetic construct
RIKFLCKLMKKLRKWQKKVGLAKLPAKLLSQVNDLKLMQP

SEQ ID NO: 656 - protein, 40 aa, synthetic construct
KLKFFRKWMKLICKGALAKLPDKAHKRQGIKYASALRCRG

SEQ ID NO: 657 - protein, 55 aa, synthetic construct
RLRWIRRWFKLMTKCAKNWARAEKREYADAAYRAYLNRPARALAARPRKLTKARG

SEQ ID NO: 658 - protein, 58 aa, synthetic construct
RFKLLTKLIRKLRNPALAKVCRMRMHVDGWERWLEPHARKARVRTRLHALHKLGASLV

SEQ ID NO: 659 - protein, 22 aa, synthetic construct
FLRFLTRLFKRWKRKLAHSTAA

SEQ ID NO: 660 - protein, 67 aa, synthetic construct
KIRLYKKFWRKLSRRHMTSNAAKMADNRRKRAGIAARRKRAASMAAAMRPRQTTQASVRRARLGRLF

SEQ ID NO: 661 - protein, 34 aa, synthetic construct
LFKFFNRLLKRIRRMPAVILLAEAKTPHCKRAFK

SEQ ID NO: 662 - protein, 74 aa, synthetic construct
KLRFFCKIFRKIRRHLLAKLAVIQRWQLPAIRAKAWRLVHATATARTRADRDRIRLKKLYARARGRQRFRALCR

SEQ ID NO: 663 - protein, 25 aa, synthetic construct
FLKMLHKLFKRICKIREAAMARRHS

SEQ ID NO: 664 - protein, 29 aa, synthetic construct
LIRMLRKFLRRWRTRHLAAAALTIKKFLA

SEQ ID NO: 665 - protein, 70 aa, synthetic construct
MMRLFRRLYKKMCNHWRLSHLRLKTYNRQAIAGAAKAPAGLQKALVLRFLARLRTLELMFYPKVKLLVDA

SEQ ID NO: 666 - protein, 36 aa, synthetic construct
IWRFYKKLMRLLKKKALACSRRLSADLEFRNKHDLV

SEQ ID NO: 667 - protein, 36 aa, synthetic construct
RMRLLSRWLRRFNKRHLWLLAKLELKLLSKWRKSIA

SEQ ID NO: 668 - protein, 25 aa, synthetic construct
MLRFFCRFLKRLHCSAKLLAHIKNR

SEQ ID NO: 669 - protein, 39 aa, synthetic construct
RLKLMRKFWRKLKTLLLHKQKRIKRCERPAGAKAALTAP

SEQ ID NO: 670 - protein, 22 aa, synthetic construct
FMRFIKKLLKKYRNALSALQLY

SEQ ID NO: 671 - protein, 20 aa, synthetic construct
YFKLYKRLLRLFKQGNLYDA

SEQ ID NO: 672 - protein, 30 aa, synthetic construct
RWKYYPRLWKKIQKLRQYQGAAKKLRLNAA

SEQ ID NO: 673 - protein, 61 aa, synthetic construct
LMKYLSRLFKKLNRARKALAKAARPRAMLKRRLGGTCGICKALQTTKSIVFCIGLRWLYLM

SEQ ID NO: 674 - protein, 24 aa, synthetic construct
MIRLMRRLLRYFKSSALNRKGLLL

SEQ ID NO: 675 - protein, 73 aa, synthetic construct
KLRMFKRLFRLFKKLAHFHVLMLYCKFRKRQINALKLDYKKRRKVALIAMKRDMLKFKRRYRHLLWKWMALWT

SEQ ID NO: 676 - protein, 40 aa, synthetic construct
KLKMMRKLLKKLRPKVDIARAQYLWMRLALSDYLYYIAAA

SEQ ID NO: 677 - protein, 25 aa, synthetic construct
LYKLMTRIMKRWHRADELKHAILLR

SEQ ID NO: 678 - protein, 23 aa, synthetic construct
KMRYITKIMKLYNRDAKLALAHL

SEQ ID NO: 679 - protein, 21 aa, synthetic construct
RFRLLRRWYKLLKHPRISYLQ

SEQ ID NO: 680 - protein, 40 aa, synthetic construct
RLKLFKKWLRKLTQRDNRRLKLLDGSAKCHNYLNHPNDRA

SEQ ID NO: 681 - protein, 46 aa, synthetic construct
YWRLLPRMLKLFKTLKLRLAYLRKLASGRKLTVAREKKQPGRQYKP

SEQ ID NO: 682 - protein, 35 aa, synthetic construct
LLRLIQRLIRLFNRKINLARMRRRVHNVKLLYLAT

SEQ ID NO: 683 - protein, 57 aa, synthetic construct
KWKFYRKLFKLLRKHAETKDIADARKLNAKCKWLVAVHCLALCARAKNRWAYIYRNR

SEQ ID NO: 684 - protein, 24 aa, synthetic construct
KLRFLRRILRYLTRRMHKCTGANL

SEQ ID NO: 685 - protein, 71 aa, synthetic construct
KFKIFTKIYKKLKRLLLGGHKPRKKVDLLFKCTNVKKLHRAPLCRAQILPLVANAFLARARKRQLFLGRKD

SEQ ID NO: 686 - protein, 33 aa, synthetic construct
LFKILCKLLKWLRRSRRMSAVDDRMAFQLRNAL

SEQ ID NO: 687 - protein, 30 aa, synthetic construct
WFRFLCKILRRLRKAKLAAYHNARARWAMQ

SEQ ID NO: 688 - protein, 34 aa, synthetic construct
WLRMLKRFYKLFQSKLHKKTMQDPLAKKKRLELG

SEQ ID NO: 689 - protein, 37 aa, synthetic construct
LLKWLKKLFRILKKDCPKANLQGACRALHFKCLNYLQ

SEQ ID NO: 690 - protein, 83 aa, synthetic construct
RMKYLPRLFRWFKKRHLPRSLCALSADGLARAVKDLRQVQKNRALHARMMANKLPLCLAFLAEARNLESTRIAKRAQRMLRAK

SEQ ID NO: 691 - protein, 74 aa, synthetic construct
ILRFYRRLLRLMHRKAHKRRLRLFAVHTMCRAAKGIRDSKAKVKLYLQLPYARASIRALEETWKKFALALAAEL

SEQ ID NO: 692 - protein, 45 aa, synthetic construct
YMKMIRKLLKKYSKLFHHLKFEANIAKVKLYQKHRAQLPLAKRLE

SEQ ID NO: 693 - protein, 89 aa, synthetic construct
FLRWYRKYLKKIKRHYKRMVRKECVENMLKRAAKACEYTVKNALKKWHAAYKALDASGGDRNHTAFLRARPAADSRKKRVRAFELALTK

SEQ ID NO: 694 - protein, 34 aa, synthetic construct
KIKLFRKLLKLLCKMGIKMLKHEARKAGWIHAYL

SEQ ID NO: 695 - protein, 36 aa, synthetic construct
KLKFFQKLLRRLKPARRKMLVLLSRLARGELELKID

SEQ ID NO: 696 - protein, 35 aa, synthetic construct
FFKYMRKLFKKLRKNDRLLCMIRLAPHALALLRYL

SEQ ID NO: 697 - protein, 98 aa, synthetic construct
KIRMLSKMFRRLRKYPTTNLQNTRRAGQPNHAHELAKHLLRLVDSFYKHHHRQLRLALRRLERRLRPMRLTKGAQAALLLRFAWPGKLLLRCRRKRTL

SEQ ID NO: 698 - protein, 23 aa, synthetic construct
LWKLFNKFIKRLRTLVADLKKTR

SEQ ID NO: 699 - protein, 60 aa, synthetic construct
RFKLLCRFLKRMRQHCAKRVRAKRLIKIANLDLKHKAECTLRPWFKKIAGYAHKRNGQAE

SEQ ID NO: 700 - protein, 74 aa, synthetic construct
FLRYLRKFMKKFRRDYAARLARCMRECRLAKAKLILRAKRCFVAFILDKRRYRGRAETHKWKFTKGYALPPIRA

SEQ ID NO: 701 - protein, 20 aa, synthetic construct
LLKLLRKWFKFFCQLNTGRK

SEQ ID NO: 702 - protein, 34 aa, synthetic construct
KIKILQRLLRKMTCFRKARAYSPRVLEAAGSLNK

SEQ ID NO: 703 - protein, 45 aa, synthetic construct
KFRLLHKMLKRLCQTEKRGPSRLLAYRRAFGRAPKKPPNKADRPL

SEQ ID NO: 704 - protein, 21 aa, synthetic construct
KWRLLNRWLKRFKNAAHLTYA

SEQ ID NO: 705 - protein, 79 aa, synthetic construct
YFKFYKRFLKRLPKARRTCYVIKEQRRGAYKPLKPLALLWCMQRLVYRRAKFKRAQAGPSKKGLKKKIVLKDLKLLHAG

SEQ ID NO: 706 - protein, 54 aa, synthetic construct
LLRMLKKFLRMLTTCHKAAKWEPARNTLLLEYVKTLRKDKLRARKKWLLKHEHA

SEQ ID NO: 707 - protein, 39 aa, synthetic construct
YLKLWRKWLKLLKKHDWLQRRRQYCGRRSTAAYKTAFLM

SEQ ID NO: 708 - protein, 59 aa, synthetic construct
MLKFLTRWLRRFKKKRMLDWLNKLAKWTIIELYRAAKDHDPKRALYEAAKLLLAVCLVW

SEQ ID NO: 709 - protein, 80 aa, synthetic construct
KMRYFRRWLRRLRPPDGRYADKLPRQRWKFMFKRLELQSRKLRRKSAPLKLAKELKASAMACFLDFKKCLQYKRLSVWPS

SEQ ID NO: 710 - protein, 25 aa, synthetic construct
ILRWFKRFLKYIKRCAKTRAGAAKA

SEQ ID NO: 711 - protein, 45 aa, synthetic construct
FLRLWCRLLRKLRRLHCKQATKAALHAGSRGFHVKRILADLFKYG

SEQ ID NO: 712 - protein, 42 aa, synthetic construct
RWKLLKKILRFMCKAHATIIRKKPLTKLGHGLLALALRKGWL

SEQ ID NO: 713 - protein, 33 aa, synthetic construct
KLRIYKKLFRRMHQTNRLRVGLRHKQRLCVALL

SEQ ID NO: 714 - protein, 37 aa, synthetic construct
RFKLFKRLWRKLSKAGRDNLHAKRHALMQVTLLCARD

SEQ ID NO: 715 - protein, 23 aa, synthetic construct
YFRLWNRIFKRWKNDKLRLLLAV

SEQ ID NO: 716 - protein, 39 aa, synthetic construct
RFKYLKRYWKIYRRCTARRKTSLSAHRTLLAAKILLSKH

SEQ ID NO: 717 - protein, 29 aa, synthetic construct
LFRLLQRWYRKIKKKLLGCEHNKLAGMNL

SEQ ID NO: 718 - protein, 44 aa, synthetic construct
LLKLLRKILRRFRKICRLGGCKLLWKSPKLKLLDRPRYQLLFMK

SEQ ID NO: 719 - protein, 20 aa, synthetic construct
KLRLFKKYMRRLHPKLANLS

SEQ ID NO: 720 - protein, 20 aa, synthetic construct
KLRYWRKILKLMHKLFGAWK

SEQ ID NO: 721 - protein, 57 aa, synthetic construct
FLRLLKKLMKRYHRARLRSKKARRFKQDFLRLKVARQALHWYACEKLRYGLIWCMTL

SEQ ID NO: 722 - protein, 36 aa, synthetic construct
LYKLMKKLFKRLTQLAMMARAWLKLLKKEKRKKSYY

SEQ ID NO: 723 - protein, 64 aa, synthetic construct
ILRLLTKLFRKYRQNRKAWLKLLQARCRIKMGVYKAKRAMRAYWIEQRRRKARERDWCSALDFT

SEQ ID NO: 724 - protein, 22 aa, synthetic construct
RLKLIKRYFRRLRNYAVALREA

SEQ ID NO: 725 - protein, 80 aa, synthetic construct
WWRLIRRILKKYKQAKKLRTWLLRLLKKKTQKDYEAKAYKRSRLRHFGILMFMLMALRAKKSYIHYCLQRRAAYVRPKLY

SEQ ID NO: 726 - protein, 38 aa, synthetic construct
KFKLLCKLLKKWSRDLSKLMLRQEIMIFFIKKNRQLLL

SEQ ID NO: 727 - protein, 28 aa, synthetic construct
FLRIFRKLLRKMNKREWRQWLPAQMAKA

SEQ ID NO: 728 - protein, 50 aa, synthetic construct
KIRIIKRILKKLKSLRTPKYAKKRKVANLKWKCLTAKNAKAFLAFLRRLM

SEQ ID NO: 729 - protein, 44 aa, synthetic construct
ILRLITRLIKRFHSVRKALRRLFFAATEWLFKFSWKLKARLVRE

SEQ ID NO: 730 - protein, 78 aa, synthetic construct
KYKLMRRFLRKWCSHEGKDLKWRTAASTRKWRLKQEAALRKLKWLSLAFALARAHFKIIKRRMMQHHVLKCAAMQAKR

SEQ ID NO: 731 - protein, 89 aa, synthetic construct
KWKILNRLIKKYHTWKCASRRAPRCQMKLKRKMGLPRDTRDRAIHRVAASAKKRRRPRAYACLAQHVYKLLKVALFNSKAVKAKYAQLD

SEQ ID NO: 732 - protein, 33 aa, synthetic construct
KLKIYTRFWKRLHRLKRFLISSAVALRDRRAYV

SEQ ID NO: 733 - protein, 84 aa, synthetic construct
FWKLYNRLFRFWKPLDEQKKMWLKPLELHKLKKLNMIGFLHRTLFLHWAAAKRARKRQMLVRGFLEFKLKARLKKKLLAAAILS

SEQ ID NO: 734 - protein, 37 aa, synthetic construct
LLRIFRRIFKKLSRYINARARRRKQACTLPNQLMAAG

SEQ ID NO: 735 - protein, 39 aa, synthetic construct
ILRLFKKYMKKIKKEALKLAGLRAVAKDQPHAKLMDFPR

SEQ ID NO: 736 - protein, 23 aa, synthetic construct
KLRLLKRFWKRLHCSRASKQKLL

SEQ ID NO: 737 - protein, 24 aa, synthetic construct
RLKLLTKFWKKFKKLASITDYALC

SEQ ID NO: 738 - protein, 20 aa, synthetic construct
RMKILKRLLKFIPKHGDAQA

SEQ ID NO: 739 - protein, 72 aa, synthetic construct
RLKLLPKLWKKMKSLFKCRWEFMAGFRCLLLKRTTNNPRARVIARRLTWIRAEYLFRKVMLVRASSAARARN

SEQ ID NO: 740 - protein, 27 aa, synthetic construct
MLKWFQKFLKRLKKLQRRALEKALWRE

SEQ ID NO: 741 - protein, 56 aa, synthetic construct
KLKFFRRFIKLMRCKKKVHVTEIHCAALHLPPKARNLKASLTKKRVRRIGAFKFLL

SEQ ID NO: 742 - protein, 28 aa, synthetic construct
KFRLLKRFLRRFRNLAAFACLKQKPMCI

SEQ ID NO: 743 - protein, 76 aa, synthetic construct
KFKLYKRMFKRLKPGRADKLAKHRGHLRYAYLSKLHLAKLRSCHCGLTRFQHIKKMLNALADKLLAYKRDRRKQMD

SEQ ID NO: 744 - protein, 70 aa, synthetic construct
LLRWLCRMLKKITRLLERKARVWFKALVMAKRPKKLYRRVRLKAREKQAARADMANLFDKEPALQEYALR

SEQ ID NO: 745 - protein, 40 aa, synthetic construct
FWRWLRKFLKIFKHDLIDRRLLCGICALCNRLRAARLRLF

SEQ ID NO: 746 - protein, 43 aa, synthetic construct
LFRLFKKLLKRIKCACLCMAKENPSLLTHRIHKLAPKRDMKAK

SEQ ID NO: 747 - protein, 42 aa, synthetic construct
RLKWLTRYIRRYSRRHWAYWKAALRLHRARVSHLCRKAKAQQ

SEQ ID NO: 748 - protein, 46 aa, synthetic construct
RIRLMKKLYKLMRKCGGAKKAMLVVSAMDAMDLKLAWCLDLAMRKK

SEQ ID NO: 749 - protein, 25 aa, synthetic construct
LYRLLKKFYKKLNKQRFLRGAGCKA

SEQ ID NO: 750 - protein, 30 aa, synthetic construct
KLRLLKKWLKRFRRDYLAIDRNFRDALLTA

SEQ ID NO: 751 - protein, 36 aa, synthetic construct
FIRMWKRWFKRIKRAHLKKLTLHIKQARLASLFHAP

SEQ ID NO: 752 - protein, 34 aa, synthetic construct
FIKFFTRMIKKLNRLRPLLLQKMRASLKSKRVAM

SEQ ID NO: 753 - protein, 31 aa, synthetic construct
KLKWLNKLIRRIRHLDRLAVDFGLAFAIRQL

SEQ ID NO: 754 - protein, 93 aa, synthetic construct
LFKLMNRYIKRLRKQAKEKLAVLRAMALDRKIMMAEAIASKAKQAKKMAAEKAASKQTAWLMRAFADKKKLAFLARLHKNWFLRLRSPGHRKA

SEQ ID NO: 755 - protein, 51 aa, synthetic construct
KLRMLRRYLRKFRKARQMRIPLLKKAFVKPLFACTWRWDCLDRAGAYLKNL

SEQ ID NO: 756 - protein, 62 aa, synthetic construct
KFRMLRRMIRKIKPKCLRLAKAWMRLKSYWRLLRKLAAYTYKKNYTQIRSATTLIDLRHIRA

SEQ ID NO: 757 - protein, 45 aa, synthetic construct
FFKYLKRFWKRLKKADWCEKMLAEKAKFNKYLCLGAMAAKWQKRR

SEQ ID NO: 758 - protein, 53 aa, synthetic construct
RMKFFPRFLKKFKPKARNRQLAKRAKKRALKHHLQAAAKRKLAEWLAWLEKLW

SEQ ID NO: 759 - protein, 44 aa, synthetic construct
RLKWLPKLLRFLKTLRRNLKPWVKALMLKDLKKALELACGAMSE

SEQ ID NO: 760 - protein, 94 aa, synthetic construct
LLKWFRRLMKLLKRLLLIMRKHHNDPKLYHQRVMAKHADANKPKYAKMLRKQACPRRWLDHEAQLQKKIIATAYKVPRARLNLTCLRIAKRRFY

SEQ ID NO: 761 - protein, 27 aa, synthetic construct
KWKFIKRLLKRLRHDMACDPKLYAIAN

SEQ ID NO: 762 - protein, 38 aa, synthetic construct
KLKMYKRFMRLLKPAANPARMKKCAENKACEICYKLLW

SEQ ID NO: 763 - protein, 20 aa, synthetic construct
KWKLLRKWYKFMKHFALKAS

SEQ ID NO: 764 - protein, 23 aa, synthetic construct
YMRLLKKYMRMLKRAPFLHARKG

SEQ ID NO: 765 - protein, 56 aa, synthetic construct
FYRFLRRFFRFLKSVKKKAWKKRIDMYMLLLLQAPLETKAILFKKRLKLITLRTFK

SEQ ID NO: 766 - protein, 36 aa, synthetic construct
KFRFIRKYLKFLKCTALAKAWRAFRKFLWKCGQAYR

SEQ ID NO: 767 - protein, 61 aa, synthetic construct
KLKYWKRLLRLMTRLRYLAIIRDILYYLLLPLKKKRISLLRKSDKASCKRCLENNLQRHAA

SEQ ID NO: 768 - protein, 40 aa, synthetic construct
FLRILRRILKLLRKRDCCFRAHKETLWACRQRLCRHLAQQ

SEQ ID NO: 769 - protein, 22 aa, synthetic construct
KLKYLRKWFRRLKHMLCGLAAK

SEQ ID NO: 770 - protein, 85 aa, synthetic construct
FYKIIRKMMKILQSDGAVAFLNYDKKHQRWQRKAALLKLLAAKWTRKLPASKWLKKKAARCAKKIVKFERWLKKFKLKKVNKLKQ

SEQ ID NO: 771 - protein, 36 aa, synthetic construct
RYRWLRRWFRLYSRDGLKTLGNQLKKRLLVAGPLKR

SEQ ID NO: 772 - protein, 27 aa, synthetic construct
LLRMWQKYLKLLKRRSRQGPMRLAIGF

SEQ ID NO: 773 - protein, 73 aa, synthetic construct
RFKFLRRIMRIMQKKALLALSAIYFSALRIAARKFAQQLRASMASAKWRGKLKTAKSKIKRPLKPVKNLALAQ

SEQ ID NO: 774 - protein, 36 aa, synthetic construct
LIRIWRRFLRKMCTFLLAAMLAARRSKLNKWFGIRN

SEQ ID NO: 775 - protein, 55 aa, synthetic construct
KMKWYKKLWKRLNKMNLAHLRQKLFKKLYMSDGAAAVCRLELRLWQKRKLQPATT

SEQ ID NO: 776 - protein, 64 aa, synthetic construct
KIKYFKRLMKLFKNLLRRAANRRSPLEAANCAGGKVDPLALAARKRQGKHTKTLILKLDNKIKD

SEQ ID NO: 777 - protein, 47 aa, synthetic construct
KYKLLRRLFRLMHRWGASQLQLAGDNAKRLWFARVRKQLYLRKTREQ

SEQ ID NO: 778 - protein, 56 aa, synthetic construct
FLKWYKKWLKKLCKSDAAALKRRELATVALGRFFCKALASQCRSRAKTVKKLWSRK

SEQ ID NO: 779 - protein, 36 aa, synthetic construct
KIKLLPKFLRIFKRFFRLDWYEKAAAKKWLGLQIRL

SEQ ID NO: 780 - protein, 33 aa, synthetic construct
MLRLIKRIYKKWKQDLAYMGAKYPWLKAHRARL

SEQ ID NO: 781 - protein, 32 aa, synthetic construct
MLRYLPRLYKLFPCREKRPGLETRALKKALDV

SEQ ID NO: 782 - protein, 45 aa, synthetic construct
KLKLYRKFLKFLKKKAAIGRAIPKWALAKLGACALDDLITKQFTE

SEQ ID NO: 783 - protein, 43 aa, synthetic construct
KLRIFRKWLRRLKQWFLILKYAYHAMHAFALYRRICRKFKGKN

SEQ ID NO: 784 - protein, 70 aa, synthetic construct
KFRWYRRYYKLFCQAHDLCAKCMPFCRIIIKRRLRLLVAGKKHAAAFAKKKARRRLGKDAQKFNAKQNFA

SEQ ID NO: 785 - protein, 20 aa, synthetic construct
LYKFIRKLWKIFKTLGALSR

SEQ ID NO: 786 - protein, 72 aa, synthetic construct
KIRFFKRLLRMYSRAAYYAHARLLFCYFEADAAKREVYRLSAALIGELRLLPRARDRIHQRCQARTKQRLAG

SEQ ID NO: 787 - protein, 61 aa, synthetic construct
IIKFLKRFIKKWHTLSPGAMKRAYVNKLSYLLHLKMLRKFQRWKLARKRRAKKLIKLPWFT

SEQ ID NO: 788 - protein, 42 aa, synthetic construct
MMRLLTKILRLLKKLRWAYFHRGARQYLKTAFKDEKGWRRKF

SEQ ID NO: 789 - protein, 38 aa, synthetic construct
KWKFYTRFLRYIQRIRKLFYAAIYKWRTAAPLLRKKAH

SEQ ID NO: 790 - protein, 89 aa, synthetic construct
RWRFLKKLLKLMRKQYWHHYALARRAREKLNFKMLKWRDKKKHRRLLIPLLLIPRRCPLKHAAWMRKGFWLPGWLPALTWNADNLRFAI

SEQ ID NO: 791 - protein, 32 aa, synthetic construct
RIKLLKRLFKMFRKPKSQAALPGNKPATCWRA

SEQ ID NO: 792 - protein, 90 aa, synthetic construct
ILKLMRRLLKKLCQAKAEFAAEAVADWRSLWARAKRALQTLGSLIMAIPFRRRPKVIAKVPQMLCRAPLRRLAGFWAAPSKIRGKRRKHR

SEQ ID NO: 793 - protein, 41 aa, synthetic construct
KLKFFRKMFKKFKRRALRRDLLLRGWNAHFGIGKIMAALKW

SEQ ID NO: 794 - protein, 24 aa, synthetic construct
LLKFMKRLIKWLKSLLRHHGRRAT

SEQ ID NO: 795 - protein, 22 aa, synthetic construct
KYKFWHKFLKRWKNNLALLAPA

SEQ ID NO: 796 - protein, 22 aa, synthetic construct
KIKLLTKLLRFLNSVVGRLRIR

SEQ ID NO: 797 - protein, 71 aa, synthetic construct
IYRYWTKLYRWWRRKAKCAVKGADKRTCKPRAKTKFMALSLKMLALARAVDRLAWWKSSRAPAEAEAPIRR

SEQ ID NO: 798 - protein, 38 aa, synthetic construct
YYRMITRIWRRLSKKPAKWWQAKALFALKTDALGKKKF

SEQ ID NO: 799 - protein, 29 aa, synthetic construct
RFRYLRRIYRRYSRLAKKSAKAICAYAAY

SEQ ID NO: 800 - protein, 65 aa, synthetic construct
FMKLFKRFLRFLTNWRAIKDKLARYQLKLQCPRRRRKLRQKVLLGYCRLDYKAGACLDACLLAPI

SEQ ID NO: 801 - protein, 68 aa, synthetic construct
KLKYFRRMLKKYRKVAPIARKWHLEKLNIVKTHRACNRALTAKLLPLFMLLWKYRKDVRAHKVLKLAG

SEQ ID NO: 802 - protein, 24 aa, synthetic construct
KFKLLNKFIRLLHKRIHKWADKAT

SEQ ID NO: 803 - protein, 92 aa, synthetic construct
IMRLFCKLFKRWRRRAFANIYRGCFLLTLPNDLKCCKESICIKFLKRHLLHALMAAMKGRRTAKAITAAQVRAKLLIVLLEIRAAALRKLLK

SEQ ID NO: 804 - protein, 39 aa, synthetic construct
LFKLFKRWYRRIRKRRQRCYPTELISDMAATLFRALARL

SEQ ID NO: 805 - protein, 20 aa, synthetic construct
LFKFLHKILRKLKQNKSLTI

SEQ ID NO: 806 - protein, 86 aa, synthetic construct
LYKILHKMLKRLRNLSARVRTKHWGLKVDAAPKKILNLREALPYLRDIAHKKLRIKWFKLWNNELWSLAAMHRKLRMSHLKYRRKD

SEQ ID NO: 807 - protein, 33 aa, synthetic construct
RLKLLKRMLKKIQKDQQCSATNAKVQARFAKNL

SEQ ID NO: 808 - protein, 20 aa, synthetic construct
KWRLLNRYLRILKRGLNMDA

SEQ ID NO: 809 - protein, 55 aa, synthetic construct
RYRWFTKFLKKFTPWAEVKKKLLARLDILGKSMFKKRALQAAKLRFKQTTRIAWL

SEQ ID NO: 810 - protein, 43 aa, synthetic construct
KLRMMKRYYRKLKRMLLLDTRWHAAALADYALKLACLHKSGKL

SEQ ID NO: 811 - protein, 48 aa, synthetic construct
LWKLFQKIIRYYCRKRWLKKKAPRTVAMRPPEAALKACVDLLRKMKKL

SEQ ID NO: 812 - protein, 56 aa, synthetic construct
LFRLYKKIIKRLHNLIKLKLKALKAQKMRLKVKSMLLLRRLGGDAKRYERMPCWGY

SEQ ID NO: 813 - protein, 80 aa, synthetic construct
YIKWFKRLYRKLNKCAVYRCRDAKFKLLFKCHQGCLLRWFDEKFCRALLLLKRFLLTPVTKAKAMKALAQAKRRKDWRCA

SEQ ID NO: 814 - protein, 29 aa, synthetic construct
YLRLYSKFWKRYRRLSPHAKSLKPRDLPA

SEQ ID NO: 815 - protein, 51 aa, synthetic construct
LLKWIKRILKRLRKYAAANIILYLRAIQTRLDLINRREREVCRKALCMAWP

SEQ ID NO: 816 - protein, 37 aa, synthetic construct
RLRLFTRLMRKFPQKAALAFEANRTNFAKRKALPAGY

SEQ ID NO: 817 - protein, 69 aa, synthetic construct
RWRMLRRFIKKLCKFNGRETAAQRLKPLVALQRRAMKYELRMRFKLRDADRLIKCAVIDNQLKAHMRVK

SEQ ID NO: 818 - protein, 38 aa, synthetic construct
KIKLYRKLLKKFKTTKNPSRRRLTCKYNLLLLAHNILS

SEQ ID NO: 819 - protein, 49 aa, synthetic construct
KWKLLKRFMRFFRPKQLLLLQKCLFACLKRYLIRWWAFFRNWIRLMYKR

SEQ ID NO: 820 - protein, 63 aa, synthetic construct
KWRWFCKFYRRLKQRLLQAPHKWETLAKRCLRAEALETAIVRKLRVNKRHKAGDLHRLKFLLM

SEQ ID NO: 821 - protein, 45 aa, synthetic construct
RFRLIRRLLRRIKTLLLAQRRYTKMYLWRAKAAGEWRIKWLGHMD

SEQ ID NO: 822 - protein, 52 aa, synthetic construct
WLKWLRRLFKKLKTRLVNLLALLDCRCKGEQKTGAKCYRGKKLRCLALLLQP

SEQ ID NO: 823 - protein, 31 aa, synthetic construct
KYKFIRKLWRLLKRATALRFLGPITKTAELF

SEQ ID NO: 824 - protein, 23 aa, synthetic construct
RLRFWCKILKYLRQHDCALRKAY

SEQ ID NO: 825 - protein, 82 aa, synthetic construct
ILRILTRFLRKISPAREKRVLRLYRLAAPIRLKRLNLVARRIARANEGLKKLWWKYTRKEKKWMAWALTLKWPQILKLLKFR

SEQ ID NO: 826 - protein, 28 aa, synthetic construct
LMKFFRKWFKKLKQKNARMPLLTARDLL

SEQ ID NO: 827 - protein, 29 aa, synthetic construct
KLRLLKKLLRWWKCQAIWGAGLLRSKHEL

SEQ ID NO: 828 - protein, 27 aa, synthetic construct
KFRMYRRLFKKLSKVNLVLEFLCELLR

SEQ ID NO: 829 - protein, 21 aa, synthetic construct
LYKLLPKYMRKLSRNKLGRYN

SEQ ID NO: 830 - protein, 35 aa, synthetic construct
KLKFWQKYWRYFRRARAGLMVLKTSLVERARARLK

SEQ ID NO: 831 - protein, 40 aa, synthetic construct
YLRLWHRLLKRYNCAKSKKVMKHRVWAAKWAIWYVAKARH

SEQ ID NO: 832 - protein, 51 aa, synthetic construct
KLKLIKRYFRLMRRWMPGAWLKAALHDKRSCTLCRAREKLDKKLDTRLESN

SEQ ID NO: 833 - protein, 50 aa, synthetic construct
KFRWFKKFLKFFSKRNRNAKAKNLLYRALPAFLAAARLQKKNKKETHHRL

SEQ ID NO: 834 - protein, 67 aa, synthetic construct
KWKWYKRYLRRFQSLLCLKLDKLALAKKMHSHECLLRKLLVISKLMDSQRLKRIAVCALKRFIMDRR

SEQ ID NO: 835 - protein, 95 aa, synthetic construct
RLKFLKKWFRLFKKGCKRARAAKTAVRDVRKLPATPVGGCHNPAYELAGAAKLCRRRAAPKKQLRRKRKLCLQALVVFHIRMKRSRRRWLAAAWD

SEQ ID NO: 836 - protein, 55 aa, synthetic construct
YIRWLSRFLRKLRKLGFHGSLDAFRDIRRKAKKTLAAMMRQDRKKAKKLTHGTLL

SEQ ID NO: 837 - protein, 46 aa, synthetic construct
RLKLLKKLLRRWKRKKDRAVELLMLHVLRKVLKLKPHPANARSMDA

SEQ ID NO: 838 - protein, 92 aa, synthetic construct
MMKYMRRFMKKLNSWKSLACCQLKEKRKVIGSMKLLNCRWDKWLRKKRWVRARGQALIDLRARLLNALGKMREAAQKAACQRNAANWLRAHA

SEQ ID NO: 839 - protein, 30 aa, synthetic construct
LIKLYKRWLRKLSRAKFDNFEGADAFLLYA

SEQ ID NO: 840 - protein, 40 aa, synthetic construct
FYKFMKKLLKRFPHALSRKSERAEAAAATKLEQQYKRGYR

SEQ ID NO: 841 - protein, 43 aa, synthetic construct
IYKLFRKLMRKLKCEHLAAALGKWLRRSLYKFGPMLWKRILKA

SEQ ID NO: 842 - protein, 45 aa, synthetic construct
RMKFYKKFLKLIRKALLSLCMRLHVAWRCSLHKRDAAAKNREAAR

SEQ ID NO: 843 - protein, 41 aa, synthetic construct
KIKLWRRMLKYWKHKRAWLRLKQKLARADAATWNSNGYPGK

SEQ ID NO: 844 - protein, 57 aa, synthetic construct
LLRFLKRLLRKMRKQHHKRYRHRLDARFHSAKERLARNFAWGLAFLPLKKRRVCWAR

SEQ ID NO: 845 - protein, 30 aa, synthetic construct
MLKYFHKYLKMFRKAARYMKAWLRERLLSE

SEQ ID NO: 846 - protein, 47 aa, synthetic construct
KLKIITKLWKKLRKNHIKRKLHSGLRLEALENAAPLFLRLRLCKDAF

SEQ ID NO: 847 - protein, 52 aa, synthetic construct
LLRIITRFLKFFKKALFHNLRPLYNSKKRERKRARLRVLNLRSIRFNKMKAL

SEQ ID NO: 848 - protein, 65 aa, synthetic construct
IWRMWQKLLKWIKRGQVAMLAAKRLCALAKDMKVKDRLQKLLLARLKANGDGLLRRWDLYARATA

SEQ ID NO: 849 - protein, 59 aa, synthetic construct
KLKYFHRYMKKLRCAACWAYQLGKAKLLARKSVKRAKANFWFLHRYFVRRRLKLKVLVK

SEQ ID NO: 850 - protein, 34 aa, synthetic construct
MYKFLRKMLRKFSRPLAPSRALHPKMAFAKRVAL

SEQ ID NO: 851 - protein, 45 aa, synthetic construct
FFRLIKRIFRLLPKGAQKAWKWRFIARRKLNKAAPMHKKRTAALM

SEQ ID NO: 852 - protein, 26 aa, synthetic construct
LLRLYKRFLRWFRKNKFLQSSLAVPR

SEQ ID NO: 853 - protein, 74 aa, synthetic construct
FFKYLKKLFRFLRHHFLAKKKLLKRACMSKAVKKHLKKKEGRKNQMRAAERAWIYCLGRARKLFAWCFCSAEKQ

SEQ ID NO: 854 - protein, 60 aa, synthetic construct
FMKFFRKLLRRWQRTRLKKAQRIAAKVCVKYAHASCLLRIAFRAQFWRASRLMIMRALTT

SEQ ID NO: 855 - protein, 41 aa, synthetic construct
LFKMFNRLMKRLCNLRRAPRLRTHAQKANKDLKAGIAGPTL

SEQ ID NO: 856 - protein, 69 aa, synthetic construct
KLRYFRKLFKYMRKSGGKLAKFANAKRKALYTKLEAWKVWALRPLLCAAKKLAAVLLRYHAWEFMRWYC

SEQ ID NO: 857 - protein, 56 aa, synthetic construct
KLKLLRKFWKLFRCSLWEYRLCPPADLNTKRKRLARRYADLAKGVHLGAEARPFSK

SEQ ID NO: 858 - protein, 42 aa, synthetic construct
KFRYIKKLLRLMNRDLMLLDCARYAWLKLAESNKFKHLQALK

SEQ ID NO: 859 - protein, 29 aa, synthetic construct
WLRLLNKFFKMFRCAKHWRASIKKTHRAL

SEQ ID NO: 860 - protein, 60 aa, synthetic construct
FYRFMCRLIRLWTCARLKRWTAGIKGRGRWACKLALDSLLMKKKDDYEARAKRTKLRRAL

SEQ ID NO: 861 - protein, 54 aa, synthetic construct
FIRFLSRLLRRLKRKRRKFCWHKKQSATARSTPLKSKDFTALPALHAYVATRRK

SEQ ID NO: 862 - protein, 28 aa, synthetic construct
LFKLYSRIIKLYRRLAWNLAVKLLDLRK

SEQ ID NO: 863 - protein, 43 aa, synthetic construct
MLRFIRKLFRKLKRFYSLRARNHAKAIADQRFKLLLIRALIHK

SEQ ID NO: 864 - protein, 20 aa, synthetic construct
FLKLWTRLWKKFCKFRRANL

SEQ ID NO: 865 - protein, 41 aa, synthetic construct
LLRILQKFLRKFCKYHKYQLVKCNKLRAARHYLVRRHARAM

SEQ ID NO: 866 - protein, 29 aa, synthetic construct
KWRLLHKFLKYLKKMKQTQRAKAPAVWGA

SEQ ID NO: 867 - protein, 33 aa, synthetic construct
YLRMLHKLFRIWKRAKLKTSLAKRRALWAKFFK

SEQ ID NO: 868 - protein, 20 aa, synthetic construct
KIRIFHRFFRRLKQAATAEL

SEQ ID NO: 869 - protein, 52 aa, synthetic construct
FWKFLPRLWKRLRTIDRRGCYRVKMRLLPLCHAKEHRLARLLRLSTRALQEH

SEQ ID NO: 870 - protein, 71 aa, synthetic construct
ILRIMRRFLRRYKKKRARAKRCKRKKVLVPPYESREAPKICYKPLLKLCGVARALYKAHAKQAMTAPLTPL

SEQ ID NO: 871 - protein, 37 aa, synthetic construct
RLRFLRKWYKRLKPKNHNQRAMLMRCPILQRLALIGR

SEQ ID NO: 872 - protein, 42 aa, synthetic construct
LYRWLKKIFRRFKRRRALELLKLKATIYLALMPRVRRVKCLE

SEQ ID NO: 873 - protein, 73 aa, synthetic construct
LLKFLRRILKKFKKSALDLMAAREALLWRKALAALLWWETVMRRKLQGRKEYLFVNTKCAMKMLFVGARVSRR

SEQ ID NO: 874 - protein, 62 aa, synthetic construct
RLKWLQKLFKLFRKLKLLREGDARECKARKIASLARALDNAKQWAHRRFIRRFRQHKLGGRA

SEQ ID NO: 875 - protein, 24 aa, synthetic construct
KLRLMPRLLRKWHSLAKSGARYEK

SEQ ID NO: 876 - protein, 81 aa, synthetic construct
RMKWFKKILRKLSRVCRIDRSDRNRLSKQPMRLQGAANASVANLKLLAKGLFAACRRRADKYAVALLDRRLRKFQSKLLLK

SEQ ID NO: 877 - protein, 70 aa, synthetic construct
MIKFLPRYLRWLRRAVKEAFSTALSAGNLRLMVLIKLRAWEKRLLMYAKKEVRKMFRALAFKPFKFMKAP

SEQ ID NO: 878 - protein, 22 aa, synthetic construct
RLRYISRLWRILRKCVLSLKLC

SEQ ID NO: 879 - protein, 20 aa, synthetic construct
FMKLFKKLWRLLSRCLAASH

SEQ ID NO: 880 - protein, 21 aa, synthetic construct
KMKLYKRLLKFLRKDNWKIAA

SEQ ID NO: 881 - protein, 41 aa, synthetic construct
RIRFMRRIIKKLKRYTLEAKKHNKACLKLIALRLLRLAARH

SEQ ID NO: 882 - protein, 32 aa, synthetic construct
KLRLIRKLFKFFCNKKAKRCSSALHALADQNL

SEQ ID NO: 883 - protein, 53 aa, synthetic construct
LYRWLHKLMRYIQKSAGLMLRVAARAYKIRAWRFKKECLRARRTAIYMILRKR

SEQ ID NO: 884 - protein, 27 aa, synthetic construct
KLKYIKRLLRKWKPWAQKGMTLCAGGA

SEQ ID NO: 885 - protein, 41 aa, synthetic construct
FLKLLTRLFKIFKNVRKRREAAADRFANRNDCAAKSIALAV

SEQ ID NO: 886 - protein, 60 aa, synthetic construct
KLRLLHKWFKLFRRKRKGDGNKPKAAIVNAVLAAKLRVLRYATLNLCLLWGLLRSTHWKK

SEQ ID NO: 887 - protein, 23 aa, synthetic construct
LFKYIRKLLKRMKTAIDLILSAK

SEQ ID NO: 888 - protein, 31 aa, synthetic construct
FLKFFRRFLKRMKCRKALEMGGVALLGRLTR

SEQ ID NO: 889 - protein, 22 aa, synthetic construct
LLRLIKRLWKIYTHWANLRKPL

SEQ ID NO: 890 - protein, 26 aa, synthetic construct
LFKWIRRMLRRLKKAGALWMQKLCTV

SEQ ID NO: 891 - protein, 62 aa, synthetic construct
WFRYFRKLLKLMPRPKQLNSLRNKCFAASRILVRLYKKLGEARAALPYCPMTALAERTRRAR

SEQ ID NO: 892 - protein, 44 aa, synthetic construct
FMKIFKRLMKKFSRATLFPMRKKALKLAKLLGMLNDKKKSLNMG

SEQ ID NO: 893 - protein, 81 aa, synthetic construct
KLKILRKLMKLLRKAALTGWAKKMRMYHILNAAVIRKWWKKQLWAYALVKPCKNIYKARRIKMLLVGGKAYNEVRRKMPKG

SEQ ID NO: 894 - protein, 56 aa, synthetic construct
LIKWWSRFWKKWRRRKAGPKYAALAYTSYKEWATLKKARARHTKAALQLWKCKARK

SEQ ID NO: 895 - protein, 38 aa, synthetic construct
RFKFLKKLMRFYHRMKANLDKGAALKIRCFKNLLWADV

SEQ ID NO: 896 - protein, 35 aa, synthetic construct
KYRIIPRYLRRIKRKRTGAGAQSRCLKNLALALKP

SEQ ID NO: 897 - protein, 40 aa, synthetic construct
RFRFLRKYLRLLRHESALMLTCLPVYNRLPAEKQRAKGRF

SEQ ID NO: 898 - protein, 52 aa, synthetic construct
RLKILRRILKRFPCPLIFRKQAYAKKLAYDKWFYEWDRLAKAAVGRRKHFAP

SEQ ID NO: 899 - protein, 23 aa, synthetic construct
IWKMLKRWLRKMSKLLAKISNPL

SEQ ID NO: 900 - protein, 45 aa, synthetic construct
KWKFISKLLKKWKKAAACVLERCKGWRWLLTSFKNAAALRDKCQL

SEQ ID NO: 901 - protein, 26 aa, synthetic construct
IYKLIRRFIRLLRPDLLAGRRARNLP

SEQ ID NO: 902 - protein, 97 aa, synthetic construct
KLRLYNRFMKIFRKCFSLKHRRVNALRKARAKWEALACNMRLKDYARQAAFLFRRWFLPGAAHKKECLHFLTFGAKLKAPLIAYLKHLATLILVQKF

SEQ ID NO: 903 - protein, 79 aa, synthetic construct
IFKYLHKLLKLLQNAKYWKKQDRSLARRTRRAHGKAKGTADIAHAKYLHMQMYYILTLWFAKLQKICKKRKLYLKKLQL

SEQ ID NO: 904 - protein, 44 aa, synthetic construct
RFRYMRRFFKLLQPRWSHQWAQCLARAAARARQAKRTLAQRARP

SEQ ID NO: 905 - protein, 87 aa, synthetic construct
RFRYLKRLWRFLKKKRWMPALIKLLVAFGAAMARCHLMDHRRQLLLRATLKPAAPALIWMRCQFKLKCYFSRDMFRKAAHSADASRP

SEQ ID NO: 906 - protein, 60 aa, synthetic construct
KLRMIRRLIKMLRKLAGRWRFGAKIVRMRQKARWQWLAKPAAGSAAAKRRGFRGMWRYCA

SEQ ID NO: 907 - protein, 88 aa, synthetic construct
KWKMLKKILRLMKRGILKKQLGGACRLESWVKNAAGMRGMFLKQAAPSAWRGAQQSDAKRWLLRRRKAAFAKLLDMLALKAYTCALSP

SEQ ID NO: 908 - protein, 29 aa, synthetic construct
LLKLLCKFLKKMRKCKNYAHQWTRLKDAA

SEQ ID NO: 909 - protein, 39 aa, synthetic construct
KLKIMQRWIKRYQRDLRAILLRSKKALCRALVSAEFLRA

SEQ ID NO: 910 - protein, 31 aa, synthetic construct
FLRWLCKYLRRLHRQLLEMLLQYEMKRKLKC

SEQ ID NO: 911 - protein, 36 aa, synthetic construct
KLRMLTRLLKLYKRMLYKGHCKAARKVKFAVCFDKQ

SEQ ID NO: 912 - protein, 21 aa, synthetic construct
FYRLWKKFLKFMRRYLQAAPK

SEQ ID NO: 913 - protein, 27 aa, synthetic construct
MLKLLQRWIRKLPCTCHLAKRLPLIGK

SEQ ID NO: 914 - protein, 48 aa, synthetic construct
WLKFLRRYWRFLRRHATVAKRLLMGRVFLAACGMEAELEQRTPALKRK

SEQ ID NO: 915 - protein, 34 aa, synthetic construct
ILKLFRKMYRLFPKFLLQLLATLGWGASRLDKRS

SEQ ID NO: 916 - protein, 35 aa, synthetic construct
LLRFFHRLMRLIRRGAKVRFRLKRLLHWQKRLELN

SEQ ID NO: 917 - protein, 29 aa, synthetic construct
YLRYFKRWLKLMRTYLAAGFLSTKFWAKK

SEQ ID NO: 918 - protein, 100 aa, synthetic construct
KIRFLRKLWRKLRSRLALRHCLPLRIAKAACCLARRQRSLCKVKLMIENPWLKKSKLDSREFKGYAVKHIALIQQRAMNQKREERCTRSQIKALRSLLAI

SEQ ID NO: 919 - protein, 29 aa, synthetic construct
LYKLFRKFLKRLPKQPMRILSKPMCAKLY

SEQ ID NO: 920 - protein, 23 aa, synthetic construct
LWRFLRRMWRRLRNQLGALAREK

SEQ ID NO: 921 - protein, 47 aa, synthetic construct
RFRLWKRFLKLWSQTAQLWQKWRRYRPIIERLANKMKRAALYKARGG

SEQ ID NO: 922 - protein, 45 aa, synthetic construct
MLKFLTRLFKLLKKQIANWWLALPWRNARVIKLKLRKSCRHRQLR

SEQ ID NO: 923 - protein, 43 aa, synthetic construct
KLKWLCKYLKRFKRADKARLYHLRGSRQLHLMPMLLAAPCYRA

SEQ ID NO: 924 - protein, 25 aa, synthetic construct
WFRLLQKFLKWLKRAGLCVRPMNKL

SEQ ID NO: 925 - protein, 77 aa, synthetic construct
RFKLLKRLIRKLKTRNLLICSKLPWFAIRVGHIYKERCAYERKCLLLLNYRRLAAKREDARAPQTKRKRAMKSQTEL

SEQ ID NO: 926 - protein, 26 aa, synthetic construct
RFRYLKKFLKRITRAFHLAAKWNLEF

SEQ ID NO: 927 - protein, 41 aa, synthetic construct
MIRFFRKLWKRIHRFAMALKRKAPEKGLAAMAYVKHRTAAR

SEQ ID NO: 928 - protein, 23 aa, synthetic construct
KLKLIHKIWKILRRAALCLNAQN

SEQ ID NO: 929 - protein, 26 aa, synthetic construct
KLRFLSKFWRRYRTKAIPAALHLSWA

SEQ ID NO: 930 - protein, 25 aa, synthetic construct
LLKLWKKLLKKFRRKGLDHLGLFAV

SEQ ID NO: 931 - protein, 35 aa, synthetic construct
RYRLLKKILKRFPPLDKHGQAARRKLLVLVKTRAR

SEQ ID NO: 932 - protein, 38 aa, synthetic construct
RMRFMRKFFKYLRRHCMPQFQLWLRLANRLALRHQLAA

SEQ ID NO: 933 - protein, 27 aa, synthetic construct
LYRWYQKYFRKLNKRMLLAKLYLTHSA

SEQ ID NO: 934 - protein, 52 aa, synthetic construct
RFRWFNRYYRKLRSKLCPSLHILCKSARHLAKRRKAEVMLTQCKQKRPLKAL

SEQ ID NO: 935 - protein, 85 aa, synthetic construct
RLKYLNKLLKKLKKKCSACQQCRLKIAVKRAAADYLFPNFRLPWKLAWAILRWWYAGTSNKRCHKAKRKMSACAFRQWHHKRVKK

SEQ ID NO: 936 - protein, 71 aa, synthetic construct
KMRLMCKFWKFLKKKLREKAKHWDKLRNAQSLLLLRGKHIKLSSKPARQWKEEVGLAAAKKVKDMRKFLEM

SEQ ID NO: 937 - protein, 61 aa, synthetic construct
RLRFIKKFFRRLRSFALCKHYAAALMVPLVRKARRAKLLKRKSSNRNVWRWASANHDKQKL

SEQ ID NO: 938 - protein, 33 aa, synthetic construct
RLRLFCRIFRWFRKRQFHPKARARTLIKLLLCA

SEQ ID NO: 939 - protein, 38 aa, synthetic construct
FFRLYKKLIKLWSTARNCARRGHIKRLKMAQRANALKI

SEQ ID NO: 940 - protein, 91 aa, synthetic construct
KLRFLRRILKFFRRKWHKFERKEASKQNILRLALASRRLAYWLSYLKRACMLSFRRELAKERFLAKRWTDAKPLRWIKKLLIVFSFIYGLT

SEQ ID NO: 941 - protein, 35 aa, synthetic construct
LLRIFRRFFKFYRRDQKMSKLKKADAKQLLAKMGL

SEQ ID NO: 942 - protein, 28 aa, synthetic construct
KFRLLRKIWKKICRHLAQLAGKEILALR

SEQ ID NO: 943 - protein, 34 aa, synthetic construct
LLKLLRKIFKYIHRARQARTAKFRFLPEKELLAT

SEQ ID NO: 944 - protein, 47 aa, synthetic construct
RWRFFTKLLRKWRKLKVRGWKRMLRNFCCDSCLLLWLRELSAKANAF

SEQ ID NO: 945 - protein, 82 aa, synthetic construct
LLKMLRKFYRKMNTSKALARAAKASCLEKRNRKLHMALIAQVRKQCQKMKSALMAFVIKKKRRHLYIRAADKKQIYMLTAML

SEQ ID NO: 946 - protein, 39 aa, synthetic construct
LYKLFRKWLKRFRTNNLLAKAHMRMRYQLECQECRLLLA

SEQ ID NO: 947 - protein, 22 aa, synthetic construct
LLRFLPRLIKYWRKASVKKASQ

SEQ ID NO: 948 - protein, 43 aa, synthetic construct
RFRLMRRWLKKLKRTSFRYILLLKVRSKTYALHFKEIAPLYAW

SEQ ID NO: 949 - protein, 45 aa, synthetic construct
FFRLLRRMLRKFKPQAKVKPASAYPIEKKAAAKWTAEKKNLLKHA

SEQ ID NO: 950 - protein, 61 aa, synthetic construct
LWKLLKKLFRFYKKPAKPFSKRDKMKLKLCWVAKAATAPPLLMNALTIKSVFMAMKRGRAD

SEQ ID NO: 951 - protein, 33 aa, synthetic construct
LFRFMQKLLRIMKHKRIALAPAFLTKRPFARRL

SEQ ID NO: 952 - protein, 43 aa, synthetic construct
RLKFMSKIWRRFKKKERALEKSQLLKARTLDHKNAIYRCLLCS

SEQ ID NO: 953 - protein, 61 aa, synthetic construct
FFRIINRLYKFLKRAVAARKDAEYRSKPPKVAMWKHLLRLQVKKREKDDRRRYVYAALACA

SEQ ID NO: 954 - protein, 41 aa, synthetic construct
KIRLYKRLLKKLKCGFALKESRPKRKKLALEAKSRWRLPLF

SEQ ID NO: 955 - protein, 20 aa, synthetic construct
RMKLINKLLKKLKKLQNHNA

SEQ ID NO: 956 - protein, 50 aa, synthetic construct
RIKFLNKMIRRLPKRTCLALLMWTALRKKCPVHFWALKANKRKALKFPLR

SEQ ID NO: 957 - protein, 59 aa, synthetic construct
KLRLLHKLLRKWPNAADKVARRTPMGGRARRRIRCWRYAPMTNMYFLLLRLLATTSWAR

SEQ ID NO: 958 - protein, 28 aa, synthetic construct
FIKLWCRLFRLMKRLEVWLERTFARKAK

SEQ ID NO: 959 - protein, 31 aa, synthetic construct
KLKLLRKLMRFLKRGKEPIDDALHFLFNLKR

SEQ ID NO: 960 - protein, 45 aa, synthetic construct
KWRYLKRIWKIMQSWALHLRILRLLDAHKRILKKLKEALARNLHL

SEQ ID NO: 961 - protein, 24 aa, synthetic construct
FLKLLHRLMKKLKKYNRTAANIKV

SEQ ID NO: 962 - protein, 30 aa, synthetic construct
WLKFFRRMLKLFCSWGKTARLRRHMLKLRG

SEQ ID NO: 963 - protein, 39 aa, synthetic construct
FYRFMRRLFKLLCRKAKAILHQWTLRHDAKWRRTAKLRY

SEQ ID NO: 964 - protein, 28 aa, synthetic construct
IYRLLPRLLKKWRPAKRTDACRTLSARR

SEQ ID NO: 965 - protein, 35 aa, synthetic construct
KFRFLPKLMRKWRKHKELCIKALPLLMKATKRHAY

SEQ ID NO: 966 - protein, 66 aa, synthetic construct
KMKWLKKLFKRICQSDRRAVEHSFPCAYLSALAACYLKKRVMLWYKNCRKKRSLKLKLRGKTWALA

SEQ ID NO: 967 - protein, 39 aa, synthetic construct
MFRYLKKLFRWWRNKALKQYCKARLRQARYTAKWNSLGA

SEQ ID NO: 968 - protein, 44 aa, synthetic construct
FLKFLCKIWKYMKKGLYSKLLRRPLLRLKLRYLGLRDGEALTAA

SEQ ID NO: 969 - protein, 56 aa, synthetic construct
FLKLYRKYMRRMQSATMDLLAIKVFVCRRRLRRQRKKRWAYSDYARATLAAKSDAF

SEQ ID NO: 970 - protein, 23 aa, synthetic construct
RFRWMQRLLRKLKHMAKLDLCYC

SEQ ID NO: 971 - protein, 49 aa, synthetic construct
FLRFLCKLMKRLHRAVLRKYHVDRRKAEPYYRSNKVAELKCKALTHKRL

SEQ ID NO: 972 - protein, 32 aa, synthetic construct
KLRFLRRLWKKLHHRLCDVLPHRFFWKLMLRC

SEQ ID NO: 973 - protein, 48 aa, synthetic construct
KIRLICRMWRKFRRGIKAMSLMKLYVHMKKWALLAPSAKDCLAARKIR

SEQ ID NO: 974 - protein, 23 aa, synthetic construct
FFKLLQKLLKRLRRSFPAREQSK

SEQ ID NO: 975 - protein, 33 aa, synthetic construct
LFRMIRRLFKKLRQKACTAKDLRAALLRKWERA

SEQ ID NO: 976 - protein, 26 aa, synthetic construct
RWKFWKKWLKLMSTAKAMACPRKLAK

SEQ ID NO: 977 - protein, 44 aa, synthetic construct
RFRIWRKLWKFWRKDDKKLRGWALKECAIKVARFLGLALAMGTA

SEQ ID NO: 978 - protein, 85 aa, synthetic construct
WIRFLRKMLKLYTKYKAEFWRALKAADKPAAKARGLKFYLIGKRRRVREALGEAKTAQCLLKKYWLLAQKGLHKMHYCGLVWIAT

SEQ ID NO: 979 - protein, 59 aa, synthetic construct
YLRMFQKILKRLKCAMDWSKVKAAWFCADARKKARSKARTMVLNKVKYAPAKAKKLKSL

SEQ ID NO: 980 - protein, 54 aa, synthetic construct
KIKLLTRWLKRLTKDEGKAPFKNSRMLKVLLAPRRRDQRRARHLLLKEIHFRIV

SEQ ID NO: 981 - protein, 34 aa, synthetic construct
FLRLIKKLLKRLRSWCKEAVVYHREKRKLQAWAP

SEQ ID NO: 982 - protein, 25 aa, synthetic construct
KFRMLQKMLRKLKKARAAYTNNDGA

SEQ ID NO: 983 - protein, 46 aa, synthetic construct
RLRLFCRFFRRLKRPSIANAKRAVARYKKLHNEQWRWAVLKCLNKD

SEQ ID NO: 984 - protein, 40 aa, synthetic construct
LMRIMRRMMKMFQKLKVDPKIARNTLLLRAAKLVKPGRKS

SEQ ID NO: 985 - protein, 56 aa, synthetic construct
KWKYWTRFLRWMKSNYKKASKLLKLEANSTFRAKLALMRLRAQSKKAARGFFSADH

SEQ ID NO: 986 - protein, 40 aa, synthetic construct
RLRWLKRFLRMMKRQAAALNEALKRFRMAATAATFVHNAK

SEQ ID NO: 987 - protein, 25 aa, synthetic construct
RYRLFKRMIRLFTHKAFRASDAQKL

SEQ ID NO: 988 - protein, 24 aa, synthetic construct
LIKMLKKLYKYLQRVETKCKLLAW

SEQ ID NO: 989 - protein, 37 aa, synthetic construct
IFKLISRLLRKLKRKLNSKFSAFTKARGYLILAAMTL

SEQ ID NO: 990 - protein, 35 aa, synthetic construct
RLKLLRKFIKFLRRFRLCFKMKLNQHKIANLGYAK

SEQ ID NO: 991 - protein, 35 aa, synthetic construct
YIRFMRRLIKFLRQRKWARAHKAVLSQKKFRAAAL

SEQ ID NO: 992 - protein, 28 aa, synthetic construct
KFRLLRRYLKMIRKQEQALRTRPRALLA

SEQ ID NO: 993 - protein, 35 aa, synthetic construct
LFRYFQKFWRRLRKAKNKSKAYDYQALRALDARCK

SEQ ID NO: 994 - protein, 31 aa, synthetic construct
LLKLLKKMMRKWKTYHKIRSAHHAKMKSALW

SEQ ID NO: 995 - protein, 20 aa, synthetic construct
LFRFLRKLLKIYKKSDQARP

SEQ ID NO: 996 - protein, 49 aa, synthetic construct
RLRLLRKIYKLLKRTALDDLKKTHQRALRKLISAARKFLLDPFLFRRSR

SEQ ID NO: 997 - protein, 36 aa, synthetic construct
RYKLIKKIYKRFRRIDDQALELWLIWRALLAQHKMK

SEQ ID NO: 998 - protein, 88 aa, synthetic construct
KMRLLKKILKRIRKNKLKVRIAYEKKMKTRFRTGKRWKHLKRVMYYDKLKRLELYLLSFLFATLGKHTASCVVALLILYAEKAICQAK

SEQ ID NO: 999 - protein, 38 aa, synthetic construct
WLRLIHRWMRRLKQWLSLDNQARWRHAAWRLKLRQKSI

SEQ ID NO: 1000 - protein, 21 aa, synthetic construct
KLKLLSKYMKRYRKPIFFGAL

SEQ ID NO: 1001 - protein, 25 aa, synthetic construct
LMRLFRKIFRFLSRDRHAFAAGKTL

SEQ ID NO: 1002 - protein, 36 aa, synthetic construct
RLRFWHRYLRKFRKKLALGYLMRHEAKARQTCLLGD

SEQ ID NO: 1003 - protein, 23 aa, synthetic construct
RLKLLKKWLKYLPRKKFIALRDA

SEQ ID NO: 1004 - protein, 35 aa, synthetic construct
RLRLLKRLLKKLKRLGKTMKYMELKSLRAELKNHR

SEQ ID NO: 1005 - protein, 45 aa, synthetic construct
KWRMLHKIYKKLPHLGRMDAAAFRSRREAIAALRLHLLAKHLRLK

SEQ ID NO: 1006 - protein, 23 aa, synthetic construct
RLKLFQRMLRFLKRMAAWATQVG

SEQ ID NO: 1007 - protein, 21 aa, synthetic construct
RLRFYPKLIKKISKLMAANCA

SEQ ID NO: 1008 - protein, 38 aa, synthetic construct
IMKYLKKFFRRWSRLPLLLRFRSLPHRKREAPNRHWAL

SEQ ID NO: 1009 - protein, 30 aa, synthetic construct
ILKLWRKLIRKMKKMQLYGMRLPNRAWART

SEQ ID NO: 1010 - protein, 56 aa, synthetic construct
KLKLMKRWYRLFRKADMWALGHGVVRLVKAKARREARRKESDAKRFQLHNKMRACA

SEQ ID NO: 1011 - protein, 31 aa, synthetic construct
MWKLWPRFMRRIKRTLLLRALKARQGGANLK

SEQ ID NO: 1012 - protein, 21 aa, synthetic construct
RIKWFKRLLKKLNHKSVANLL

SEQ ID NO: 1013 - protein, 50 aa, synthetic construct
RLKLMRKWLKRLSCLKKALKVIYMLALKLGGPKAFQNTAMRKKLLMHGAA

SEQ ID NO: 1014 - protein, 32 aa, synthetic construct
ILRWLKKWWKKLKCEFPRALRRAKLNPDEAFA

SEQ ID NO: 1015 - protein, 85 aa, synthetic construct
KYKYFRKLLRRWRRKPLEFRRTNRWYLTLSAKLWKAENKVRQHWMRAKSRFVLFRKLKANAARARAEAYAWRKPYILVFKMLVFG

SEQ ID NO: 1016 - protein, 81 aa, synthetic construct
RMKIFHRYIKRLQRLPNRYLLHKKAAKELAPWVKAAPKGAAHLLPQVERCLNARKPDSNNFKASFTLHRAVRRLKAYRKRK

SEQ ID NO: 1017 - protein, 48 aa, synthetic construct
RLRLLRKFYRLLKKVTIERYYLSLCIAARHKKKVALWCASLIRKDLKA

SEQ ID NO: 1018 - protein, 73 aa, synthetic construct
KMRLLRKYLRRFKRRKPEAAFAAALLFWRRYACDCSRVRPKYYVIRLWYAGLLRVARWLVRARPFQQRVLRNL

SEQ ID NO: 1019 - protein, 38 aa, synthetic construct
FLRLLNRWFRKFKHRQKDPLHAEARALWHLKLLKQLRE

SEQ ID NO: 1020 - protein, 41 aa, synthetic construct
IWKILKRMFRRLKKLRYKTLKLLQRVAILCVLELMQNSLKV

SEQ ID NO: 1021 - protein, 32 aa, synthetic construct
LFKILNRYWKFMSKRKLRPAKPCAAHAMALFR

SEQ ID NO: 1022 - protein, 23 aa, synthetic construct
WLRLYKRLFRKFTQALWADRLRK

SEQ ID NO: 1023 - protein, 67 aa, synthetic construct
RFKLFTKFFKLWRKKPAKLALGWAMPQKTKFLRLLNLKAHVTGPALWPTVAHARAKAAAKWKYKRGS

SEQ ID NO: 1024 - protein, 21 aa, synthetic construct
IIKLFRRWFRRMRQLLKALEA

SEQ ID NO: 1025 - protein, 24 aa, synthetic construct
RLRLYCRYYKRLRCYLARAKCHAN

SEQ ID NO: 1026 - protein, 27 aa, synthetic construct
KLKIWKKIIRKWKSGAWRDQRYAALLL

SEQ ID NO: 1027 - protein, 45 aa, synthetic construct
FIKFLKRWLKLLRSALKCRQLRHKTVLLKMYPCLLWAAGGHKWKM

SEQ ID NO: 1028 - protein, 32 aa, synthetic construct
MIRLINKLIKRLTKLEMAAKRLYGNRAWRLRS

SEQ ID NO: 1029 - protein, 34 aa, synthetic construct
FMKFLRRLLRLFQCRRSCELKFHAFLAWLSRKTA

SEQ ID NO: 1030 - protein, 20 aa, synthetic construct
KWKMLNRLLRKMPKTNLLWW

SEQ ID NO: 1031 - protein, 43 aa, synthetic construct
LLKYLRRYYKRLKQHAPLRKRMKLHRPAKQSKCRLAHELIDRL

SEQ ID NO: 1032 - protein, 26 aa, synthetic construct
IWKFFPRLLRRLTKCKAWLAQACNKA

SEQ ID NO: 1033 - protein, 31 aa, synthetic construct
LLRYFHKFYKKFKRAKKYANAVLANDWKRAG

SEQ ID NO: 1034 - protein, 32 aa, synthetic construct
KLRFWPRIMRKFKNRAAKMGAVRKADIALTWL

SEQ ID NO: 1035 - protein, 65 aa, synthetic construct
KFRIYRRMLRIIKKMSLTAPPGLAFIRLRLHASIPAKRALRKLFCKLARYFLRKLLQKKIFCMLS

SEQ ID NO: 1036 - protein, 62 aa, synthetic construct
YLRWYKKLLKRMKKSRTRHPIRLKKLGWLNKKQLLPAWYKASIPMKAARALLRKEHVFDLEP

SEQ ID NO: 1037 - protein, 65 aa, synthetic construct
RMRWFRRIMKRLCRLLFKKAASQLKCNHFLKARDLKLYLRKAGTNWVCRLQYAACSHRVKARANF

SEQ ID NO: 1038 - protein, 27 aa, synthetic construct
LFKLWCKLFRRLHHKLPCSLAVRWFRR

SEQ ID NO: 1039 - protein, 46 aa, synthetic construct
KLRIFHRWLKFFRRAALTIKAARWILNNARPKARPAVGRADALTCV

SEQ ID NO: 1040 - protein, 96 aa, synthetic construct
LFKLYKKFWKRLQNLRKMRLKCLRLAKAKRGREEWRAVKACCHRSKGNKLKYVLLKAKEQPFYRAKMIGKAFFAAAARRMYLIARQNCEHKRKRAK

SEQ ID NO: 1041 - protein, 24 aa, synthetic construct
KMRIYCKLWKKLRHLLHRARLQAC

SEQ ID NO: 1042 - protein, 71 aa, synthetic construct
FLKIINRLFKKLPRLTFGKKCRLKCTLKAQAYQAAETKAVFGRKRRLAWDMAKRPKKKKKLGQSLELEQAH

SEQ ID NO: 1043 - protein, 45 aa, synthetic construct
RFKLWKRLLRLLHKRLRLKNIATAMHNESAKAQARLLGQHVEHSI

SEQ ID NO: 1044 - protein, 48 aa, synthetic construct
FLKLYRKIFRLIKQNAIQMLIRFALHIKQLAIKLATLCRRDRRCLEAK

SEQ ID NO: 1045 - protein, 94 aa, synthetic construct
KLKMLHRLLKRIRRKLIERYLQALAKEWRSGEKLRPRILMCAKKPFGMKLGAEKSWMTKSRKKHMAKRTAQAAGTDLKCEASAKLYFLRKAEMR

SEQ ID NO: 1046 - protein, 35 aa, synthetic construct
KFRFFHRFWKLYRRHRLRLCRLMQHAPRRARLCLA

SEQ ID NO: 1047 - protein, 66 aa, synthetic construct
RFRYLRRLLRLFKPKKRTCLQYCFAAQLDELQADRSEEKLRWAKYFKRIAHALAKHCGRKRRRKWN

SEQ ID NO: 1048 - protein, 36 aa, synthetic construct
LLKLLKRYFRKFQNEPYYCLAGTRHHRYKDLKLKKA

SEQ ID NO: 1049 - protein, 82 aa, synthetic construct
RIRYLKKWYKFLQRHDRGARIATRERYYHFRKATKKHKANTLTRLKRLCNLCKIKCALSCDNKAADEKKAMWLAKALPRRKM

SEQ ID NO: 1050 - protein, 20 aa, synthetic construct
ILRMWKRYLRFYKRASKLFL

SEQ ID NO: 1051 - protein, 29 aa, synthetic construct
LIKLLPKLYRIINRLAKYRRNLWMCRIKY

SEQ ID NO: 1052 - protein, 23 aa, synthetic construct
KYKFLTKFLKLFQRPYLLLLIRN

SEQ ID NO: 1053 - protein, 20 aa, synthetic construct
RYKLYSRWFKWLPKARARLV

SEQ ID NO: 1054 - protein, 36 aa, synthetic construct
KFKLLKKIIRMLRHHAKHCNRAAKRLREKIAGAYLV

SEQ ID NO: 1055 - protein, 20 aa, synthetic construct
KLRLLRRILKMWPQFKEGRL

SEQ ID NO: 1056 - protein, 45 aa, synthetic construct
RLRLLNRYMKWLKRLCADGRAYHCCTCAKRAYYIRAAARDKLTKL

SEQ ID NO: 1057 - protein, 25 aa, synthetic construct
FIRFLRKFMKLIKKYAHLKLLKNKL

SEQ ID NO: 1058 - protein, 65 aa, synthetic construct
LMRMFRRLFKYFKRIKSKHAAKWMKRKCWLLKALLFKAVPKAAEVRRLKQLVRSSLRLRGWYFLV

SEQ ID NO: 1059 - protein, 92 aa, synthetic construct
RFRFLKKLLRLLPTKKPDPYTEADCGLPSTREDLRRHRSLRLALKKRALFKRSHALTNKAGKDRWYKAVWADLKTFNKFPRRFLPKPKAPRL

SEQ ID NO: 1060 - protein, 78 aa, synthetic construct
RMRFFKKYWRRLKPCWAGMYFLRATGRMTLKLRAYLWYIKLARGKRPRYAAAAGVRRVKALKQQLLHNAGACMIKKLS

SEQ ID NO: 1061 - protein, 74 aa, synthetic construct
LWKMLRKFLRMMRKKKHILQAKTRLDYACKGVSTRGHVLTLLKLCCRAKRLRGCAKQKKKALCLNNNRIGKGDR

SEQ ID NO: 1062 - protein, 64 aa, synthetic construct
FLRWLTKFIRMIKRIAIYRRHTRAGLRRAHTKAEGLAADAQAGALRAFARCKDKKFLRGRPPYK

SEQ ID NO: 1063 - protein, 49 aa, synthetic construct
KIRFLRRWYKFLSKELAKFPARRRHLALSARHEMKNRRAITTAKAWRAL

SEQ ID NO: 1064 - protein, 30 aa, synthetic construct
RLRFLQKLMKWYSHWDKWGRQLKWRALRAA

SEQ ID NO: 1065 - protein, 43 aa, synthetic construct
RLRFFRRWFKLLRRRLALKNPGKRDKLTKALFQLAMRRAAREC

SEQ ID NO: 1066 - protein, 54 aa, synthetic construct
FLRWLTRLLRRLRHRKLNAIPCLMNIRVTHKHAVRFMDETLLADRLLWKLTLKR

SEQ ID NO: 1067 - protein, 86 aa, synthetic construct
RFRMYKRLYRRYTSIKAYAGLNPACYRDIRRKDARQVCTPKLKTRKLRPFAKHRRLCKSLYCRNKATCRASAALDALKAAVRAKVE

SEQ ID NO: 1068 - protein, 56 aa, synthetic construct
KLRLLRKWFKRIRKLPNRMWLIAPRCKALAKVLKYIFALHRAQADQRITMALDLRY

SEQ ID NO: 1069 - protein, 29 aa, synthetic construct
KWRLFRRLLRRFHQKRLLPPKKHDCLASL

SEQ ID NO: 1070 - protein, 44 aa, synthetic construct
KLKYFTKLLRYIRNALRNNRSDYRRQLKMNFVLSALLRKSLRLI

SEQ ID NO: 1071 - protein, 34 aa, synthetic construct
KFKWFCKFLKKFRKKLYLWGAAMLRYLKEQRASI

SEQ ID NO: 1072 - protein, 36 aa, synthetic construct
LIRLYKKLMRLMRNFAALKKKAMAIRSRLLWEKLTK

SEQ ID NO: 1073 - protein, 23 aa, synthetic construct
ILKMLTKLYKLLNQKRMRRKAWQ

SEQ ID NO: 1074 - protein, 26 aa, synthetic construct
RLKLMKKLWKWLNCCKTKRLARVNNL

SEQ ID NO: 1075 - protein, 26 aa, synthetic construct
KFRFLTKYLKLLPRRALLSERTVPFL

SEQ ID NO: 1076 - protein, 36 aa, synthetic construct
KYRYFQKLLKFLKKRFAECCKLARYGSKFTLANAAK

SEQ ID NO: 1077 - protein, 34 aa, synthetic construct
RLRLLNKYLKKFPKSAALRRSSWQLFDQVAIKFL

SEQ ID NO: 1078 - protein, 28 aa, synthetic construct
KLKFYQKWFKKLCRAAKELHAIMLKCAA

SEQ ID NO: 1079 - protein, 27 aa, synthetic construct
KFKFLPRILKLWKKMYAKAARRFACLD

SEQ ID NO: 1080 - protein, 20 aa, synthetic construct
RMKFYSRLLRLYRRVPQAVA

SEQ ID NO: 1081 - protein, 38 aa, synthetic construct
RLRLLKRYLKWFNKRRNNHAKAAIAGPKQFSLAMKQLK

SEQ ID NO: 1082 - protein, 21 aa, synthetic construct
WFRILHKLMKYMKKVKLELAA

SEQ ID NO: 1083 - protein, 51 aa, synthetic construct
LLRIFKKLWKLLRCRALNLYLKVRRARRLCAPAWLANLKKARALKLNHELK

SEQ ID NO: 1084 - protein, 48 aa, synthetic construct
RMRLFQRLFRLYHPRLLKIKCRRLDTKLCAYNEQAFARKKKQKKLLHI

SEQ ID NO: 1085 - protein, 38 aa, synthetic construct
RLKLFPKFMRKWRKLEKCAAHQRLIARLAKRHVLYLRT

SEQ ID NO: 1086 - protein, 32 aa, synthetic construct
RIKLISKYFKKWKSCYRAWLFSANRTRLAALR

SEQ ID NO: 1087 - protein, 47 aa, synthetic construct
RLKLLKRYIKFLKHSKSELLWAKAKGWTIMKPPKSDAERKDALAKAR

SEQ ID NO: 1088 - protein, 61 aa, synthetic construct
LFRYIKKLFRLWTKFLAALLALAKWPKLFKEKPVPRKGDRKHDIGFGNARAPWARHKILRK

SEQ ID NO: 1089 - protein, 43 aa, synthetic construct
ILKWWKKMLRKYRPLKNFNRFQRRCLLWKLAQACKKRLAACEL

SEQ ID NO: 1090 - protein, 79 aa, synthetic construct
FFRLIKKLLRLFTKLAADVKRAKGHWLTAKKFEHKKHEARKKAPRYQNANHQKACLKRDGRLALRARKNKPRMRKLWQS

SEQ ID NO: 1091 - protein, 24 aa, synthetic construct
LWKLLKRIFRKLRKLHCRLALDHR

SEQ ID NO: 1092 - protein, 47 aa, synthetic construct
LWRLLHRFIRLMKPKRAGLYAKTKVIHRRLTDKLKRHDIALKHNEAH

SEQ ID NO: 1093 - protein, 20 aa, synthetic construct
RYKMFKRYLRRFTQNLLLAE

SEQ ID NO: 1094 - protein, 58 aa, synthetic construct
RLRWLQRLFRKFPRLEFPVQARRYVRNLATTLKHAFSRCYARARRDLKAARSRYLLWW

SEQ ID NO: 1095 - protein, 56 aa, synthetic construct
RFRIFKRFLRKFRKQREWREKLCLTVRLGLRAFGLKKLNWTKIALLALGTFKSVVL

SEQ ID NO: 1096 - protein, 32 aa, synthetic construct
KIRLLKKLLRKFRHVVLKYMWLQYLLSKRRNA

SEQ ID NO: 1097 - protein, 26 aa, synthetic construct
RFKFLRRMLRMFKNYLLTYLLRWAKK

SEQ ID NO: 1098 - protein, 46 aa, synthetic construct
KLRLLSKLLKFLKKRAILDRRAFNFNACRHKRQDAAIKLKIHNLKK

SEQ ID NO: 1099 - protein, 60 aa, synthetic construct
FFKFLKRWFRKFKTADCMHLFGADFNRKTLMEKFINLMKRYLLRDILKDAKLKRAKLARK

SEQ ID NO: 1100 - protein, 28 aa, synthetic construct
KLKFLRKLYKLLKRINLGWAFLFRKAQK

SEQ ID NO: 1101 - protein, 43 aa, synthetic construct
KLKLFPKLMKKFSCKLLTTLEGQRYLKQVRPRLNARAILVLQA

SEQ ID NO: 1102 - protein, 91 aa, synthetic construct
MLRWFSRIFRRLRRRAAKFARLLCCQALCFKFCHPKRQRRAWCVSHFAAPALLVFRRAKGATAADWLATLWVRACRKQARLALPTVHLRAK

SEQ ID NO: 1103 - protein, 51 aa, synthetic construct
FLRWFSRLLRKINRHIVAKVQDRLRKANAAKVASLLRHAVTLAWKEAFRCA

SEQ ID NO: 1104 - protein, 80 aa, synthetic construct
KFRLFCKLLRKLPPARPLLRRKLMERLRVNKAALKTLTALQLNQLDMGVLGKAYRSPHLRAKKTLGEMNILRRMGLKWAR

SEQ ID NO: 1105 - protein, 37 aa, synthetic construct
KMRLLRRLFKKYRQADKDNTKALRHMWAGPLMARRAG

SEQ ID NO: 1106 - protein, 32 aa, synthetic construct
LLKLWNKLLRRLQCLAVSFLLRNKDRKKEPTT

SEQ ID NO: 1107 - protein, 72 aa, synthetic construct
KLKLLHKLWKFFQHKEALRAIVFLELKAYHDRKLAKRLLLTAFALNSQALGCAYCLIQNLRNFFRCKKKMYR

SEQ ID NO: 1108 - protein, 38 aa, synthetic construct
LFRLFKRYWKLLRRKLKMAVKDAQFGKKHRAAYAADDK

SEQ ID NO: 1109 - protein, 40 aa, synthetic construct
RYKMLKKIFKYWQRRHYDKALMLAGADQKRKYRFLLLLPA

SEQ ID NO: 1110 - protein, 36 aa, synthetic construct
FFRLLPKWMKLYPKFARCACRKNLTNLAWLGAKRRL

SEQ ID NO: 1111 - protein, 71 aa, synthetic construct
MLRLWPRFLKKLKSDRAKLAIIPEIRYYRKKLKYLDIKKERLTSCEAPFLCRLAAARYLIHDKIRLKLLSR

SEQ ID NO: 1112 - protein, 48 aa, synthetic construct
MLKLMNRLLRKFRHTKALGKLRNMLSDKLKNRKIALWSLECPTAAVMK

SEQ ID NO: 1113 - protein, 48 aa, synthetic construct
LWKFFKRFYRIWNKLRCNYQRKRKKFRFAAALAEPARMDLALAQAALL

SEQ ID NO: 1114 - protein, 25 aa, synthetic construct
RLRLIKRLLRMFNRWGWAAQEKEVK

SEQ ID NO: 1115 - protein, 30 aa, synthetic construct
IWKFMKRFLRRLKCLRYQASLLTDRKRLPC

SEQ ID NO: 1116 - protein, 90 aa, synthetic construct
KWKLFCKFLRLYRRLAILAARRHAMYFRALLMETAEHRRCALLMDKRLLQYCAWIVIKKRLKSALKTIRFIYTTRRKTLMLRKFPARGVR

SEQ ID NO: 1117 - protein, 22 aa, synthetic construct
LLKMIQRLLRRMHQRMALPAKA

SEQ ID NO: 1118 - protein, 34 aa, synthetic construct
RWRYLHRLLKKLTTEWYKLLAWPCLHLARTWRAN

SEQ ID NO: 1119 - protein, 43 aa, synthetic construct
WMRWLKRLWKKFQRHSAALCRKEAKWGRVIRLARAVQLDLRRL

SEQ ID NO: 1120 - protein, 52 aa, synthetic construct
LFRYMRRFWRMLSKRAQKQELTYRLEAEREKKLARGQWRRKMHCLRAKALKL

SEQ ID NO: 1121 - protein, 79 aa, synthetic construct
KLKLYRRLLRRFRKCLAYKFRLKYQDKYRCHTRLKNRQVTHWKSLMAAWKKLQRNQRKNLVPRERNHQGALLAAKQPDL

SEQ ID NO: 1122 - protein, 56 aa, synthetic construct
RIRLYKRILRRYKPAAMSALGTTKHRLKKKLLKCSATTRVLQSKAYLNCRLSKRNR

SEQ ID NO: 1123 - protein, 39 aa, synthetic construct
LIRLYRRWLRRLPRLAFARCRACLGGRIEAYYKKQAHPL

SEQ ID NO: 1124 - protein, 31 aa, synthetic construct
LWRLLRKWYKFFKRTAVRKLAAAMLEFHEKW

SEQ ID NO: 1125 - protein, 72 aa, synthetic construct
KFKLLRRLLKWLCRCQSVAHRSAVYWRSWLLLARRQGEIYLFRALRVQFWRKKIQYKERARRLTLAARYRPL

SEQ ID NO: 1126 - protein, 36 aa, synthetic construct
RFKMIQRWIKRMHCYLKKRDFLRKDRQALLLAAVAW

SEQ ID NO: 1127 - protein, 51 aa, synthetic construct
KLRIFKRLFKYFRKEFWKKRKHLALCSKLEDLKLLKLNKRDNAYWQAARVQ

SEQ ID NO: 1128 - protein, 58 aa, synthetic construct
KWRLYKRLMRLMKTYKSNLLAFALDKKAEELEASKCLQRMCRHHKNRRRAFALLHDNW

SEQ ID NO: 1129 - protein, 47 aa, synthetic construct
RLKLLCKYLKKYSRLRRLRGGFREWFKARTLRAHRIYFITVDASQAL

SEQ ID NO: 1130 - protein, 29 aa, synthetic construct
LYRFLKKFLKKLTKVKRLAAYTEYVLFIY

SEQ ID NO: 1131 - protein, 23 aa, synthetic construct
LLKFWKKYLKWIRRTAARQATAT

SEQ ID NO: 1132 - protein, 28 aa, synthetic construct
RWRILHKMFKKFPKALIRLCIRLNALLM

SEQ ID NO: 1133 - protein, 52 aa, synthetic construct
KWKLYHRFWRKLKNRLCMITTGKAAITANKACHALKQQGAMHKRKRLELKAL

SEQ ID NO: 1134 - protein, 69 aa, synthetic construct
KFRYYRKLIKWFKKHFNPKQAPAKRALDRDRRARAPTRLPKNLKARMLRSLYRIANQIIWCSKRLLPLQ

SEQ ID NO: 1135 - protein, 31 aa, synthetic construct
KFRFLKKLYRLWKKLALKTRCMPKLAAERAY

SEQ ID NO: 1136 - protein, 50 aa, synthetic construct
KLKLLCKLIKFLQRAYVDANALLTYMLRKLQNHTEGKRRVAKHMRHKKKL

SEQ ID NO: 1137 - protein, 32 aa, synthetic construct
RYKLMQRYFRRLNQLARLCHHKWRAAEASNRL

SEQ ID NO: 1138 - protein, 27 aa, synthetic construct
MLRFLRKIMKWLKRWGKRAHWAAKACA

SEQ ID NO: 1139 - protein, 41 aa, synthetic construct
FIKLFRKILRKFRPAVELARLYLLNKCRAAHDQRLWLAHKQ

SEQ ID NO: 1140 - protein, 26 aa, synthetic construct
KFRLLPKLWKRFHKTLALIAHAKAVP

SEQ ID NO: 1141 - protein, 33 aa, synthetic construct
KLRILNKLYKMWRRAASKRSWSGGCPALRKAHL

SEQ ID NO: 1142 - protein, 58 aa, synthetic construct
RYKLLQKLFRRLNRDHVSRALLKYRVLILLARRGADLFKKKCMDRATAHCADKDAKCA

SEQ ID NO: 1143 - protein, 23 aa, synthetic construct
RLRFFKKLMRRYSKGLATKAQLW

SEQ ID NO: 1144 - protein, 57 aa, synthetic construct
KLKYFRRMFKLYRKLFVQRARAWANYWAAAHLKALKKAFMNGHLRMAKTLYYRLALP

SEQ ID NO: 1145 - protein, 36 aa, synthetic construct
RFRILSKLFRRMRSDCAQAKILLKRACLGYKRHPKA

SEQ ID NO: 1146 - protein, 54 aa, synthetic construct
KLKIIQRLLKKIRQSIALHQLPKAANLLQDERRWDRLLPAKVKAASEQKPNRFR

SEQ ID NO: 1147 - protein, 36 aa, synthetic construct
FIRMLRRLLRLLHNRSHHRSLYVLRAALGQLEKLRN

SEQ ID NO: 1148 - protein, 44 aa, synthetic construct
RFKLIRKWLRRWKKHAQKRLKLLYLFVRMMQDLREKKAFLHNLV

SEQ ID NO: 1149 - protein, 70 aa, synthetic construct
YFKWLSRIFRKIKRKKRAKRKRAEILRFDLCNANTQIKLHVRDAPPKKTQKLMLALLHLKAMLFRPKPLL

SEQ ID NO: 1150 - protein, 24 aa, synthetic construct
KLKWLRKWIKKLTQHIAKLTRLKA

SEQ ID NO: 1151 - protein, 28 aa, synthetic construct
WLRIMRRLFKLYSRLLLRTRCCRRLLWR

SEQ ID NO: 1152 - protein, 28 aa, synthetic construct
LFKFFQKLLKKMHRDKAKLARQECHLLA

SEQ ID NO: 1153 - protein, 29 aa, synthetic construct
RLRFFPKYFRKLKKAAREIVKNTDLLGAI

SEQ ID NO: 1154 - protein, 63 aa, synthetic construct
MWKMLRRYFRLLRKLLWGKWRKAYLKHALIDLGKCAGNVFLRNLARLMNIGLCHKRARGLSLD

SEQ ID NO: 1155 - protein, 66 aa, synthetic construct
RLRFWPRLFRRWCRRRRHVNSKQKVCLRKKLPIEAIAKNRGNCALAAMDKARKHGWAAILLARLAF

SEQ ID NO: 1156 - protein, 35 aa, synthetic construct
RMRLYPKFLKLFKQAIAEALKLKKAYRKHAKYKCL

SEQ ID NO: 1157 - protein, 57 aa, synthetic construct
FFRLFRKMFKLLPKPYVGAKRMLMLRDGPLQTVAALAKALAGCLGKDKLRREPRRVR

SEQ ID NO: 1158 - protein, 33 aa, synthetic construct
RFRILHKLFRKLRQCQRWLSALYKLIKLLWLLA

SEQ ID NO: 1159 - protein, 82 aa, synthetic construct
LWRLFRKFWRRLRKKAEILFFNSYSASRMARMLMRLARTKLKKAFGIALANKADDLRLAKFRLFGKSEASAPRERRGYKRRY

SEQ ID NO: 1160 - protein, 68 aa, synthetic construct
FWKILSRLLRMLSHKKNLYCLYKRVDLKRRPRKLIAGKDYPLAKKMLSGKRICKTLVMCLAAAKLMHK

SEQ ID NO: 1161 - protein, 50 aa, synthetic construct
KLRLFRKYLKWLKCRRARDRWLAKLLRRFAPLRFLNMKFTVLPAARLWWM

SEQ ID NO: 1162 - protein, 52 aa, synthetic construct
RYKFLTRYYRLIRRCLCCWCRAKAAAAMRWTFRSRARGAMRQKVLALKFIIK

SEQ ID NO: 1163 - protein, 55 aa, synthetic construct
LWKFLKKWYKKLCKCKLVALSSGMMVLLLANAKKEIDKERSAIRLAAAYICAKWA

SEQ ID NO: 1164 - protein, 58 aa, synthetic construct
RLRFLRRLLRFFNKCPARRPAHWRKASRLKRLILTMMRKTIPLAKTLGKARTPVRCIA

SEQ ID NO: 1165 - protein, 89 aa, synthetic construct
YYRLFSRFFRKFKNLRKRLRSDDALAPHFARKKKACPVRSGCLLFLAEMKLACKLKQARVRPKKALTAMRYLVMKFALYDQLFLALFAN

SEQ ID NO: 1166 - protein, 63 aa, synthetic construct
KLRYWRKLFRRWNTKKRWLLLKLCAQSRMALGYCEAPFNKRQWSKAYRRRIKAVRHAKLCLGA

SEQ ID NO: 1167 - protein, 26 aa, synthetic construct
LLKILTRLFKMLKKHKMAATARAGFQ

SEQ ID NO: 1168 - protein, 31 aa, synthetic construct
KFKIYRKFLKKYKTVAIAMFAFELLLIRKLR

SEQ ID NO: 1169 - protein, 71 aa, synthetic construct
KIKYLQKFFKRFRRSLANNIVCCPSAAARTHQKFPLLLRARDAKRAATKLGIKRRTKEKAWCRCKLKKLYD

SEQ ID NO: 1170 - protein, 42 aa, synthetic construct
KFRLLSKYIRLLKRWRLAGRHLWKLREAQASGYACARWKALE

SEQ ID NO: 1171 - protein, 78 aa, synthetic construct
KFRIMPRFLKLLKKRKNAELKAANKALEQKKFKGALPAEAANNLHQARSWAALLTFYRVNAKLKDHRRRMRALSATAW

SEQ ID NO: 1172 - protein, 92 aa, synthetic construct
RFRFIPRFMKRLSTTTELARHACKRLLTLQRLRNTRKLDLILLKLLARAHMMAARVPALRANAKQRILRQRNLASKKEKDLRNICFTHPKRI

SEQ ID NO: 1173 - protein, 75 aa, synthetic construct
KFRFLRRMIKRMKKIYVGKDLKYTLLRWNRKEALIKERSAILPLKKNALAVKRRIYALLNARAILLMPFFLLGAK

SEQ ID NO: 1174 - protein, 20 aa, synthetic construct
KLKFLNKLWRRIHQEREKAL

SEQ ID NO: 1175 - protein, 27 aa, synthetic construct
RLRYLRKYFKILKSMNNQLKAGKLANV

SEQ ID NO: 1176 - protein, 60 aa, synthetic construct
KLKIMCKLMRYFKKRTLTASKRHLRKAMRLIAEKCMKLSQKARMSIDKLLLRALAAAHMR

SEQ ID NO: 1177 - protein, 86 aa, synthetic construct
YIRFLKRLLKRFSQMFTNLKLVRRFLLKRKADRALKLSCKRWIADHSRASLKCDRAASDALAYKAVKQRHRGFLRDQAPKGDHLRF

SEQ ID NO: 1178 - protein, 43 aa, synthetic construct
RMRWFKRLLRYLPNASALLAIALKKQSRWLAKTDARMLQWVMK

SEQ ID NO: 1179 - protein, 48 aa, synthetic construct
LWRLLRRLMKMLRQKARAYPAEAKISRNHKKLKKYVRARNAGEHAGRT

SEQ ID NO: 1180 - protein, 36 aa, synthetic construct
RYRFWRRMYKWLRRQLALTRAASLANLAGGRELACF

SEQ ID NO: 1181 - protein, 20 aa, synthetic construct
YIRFLNRFLKFLPCKKKQAA

SEQ ID NO: 1182 - protein, 49 aa, synthetic construct
KYKFYQKLWKYIRCWDNAKRYDRSGRLRLLMAKASKAKLFAKAMACDFA

SEQ ID NO: 1183 - protein, 25 aa, synthetic construct
YLKLLRRLLKRMTQHYTAMAKRCQN

SEQ ID NO: 1184 - protein, 53 aa, synthetic construct
RFRLIKRLLKRFHRQDYIGLNYEESRYDSLAKWARLRRALTLRAMMQKLLLKP

SEQ ID NO: 1185 - protein, 63 aa, synthetic construct
WFKLLKKLLKIYTRPKPTLLFPLALMSNSEALKVKQRKARYMLFMTLRRRKRLQRCRGHRVIA

SEQ ID NO: 1186 - protein, 21 aa, synthetic construct
RIRLLKRLMRKMSPVKAEGLL

SEQ ID NO: 1187 - protein, 47 aa, synthetic construct
LFRLIRKFLRRFRSRAAKQFLMMAHLRKAPEHWIRLKLNDKYARARR

SEQ ID NO: 1188 - protein, 22 aa, synthetic construct
KLRLFPRLIRLFRKGARHKMAY

SEQ ID NO: 1189 - protein, 35 aa, synthetic construct
RLRLYKKLFRFLRRRKLIDRSAFGRTNSLLCAMFL

SEQ ID NO: 1190 - protein, 30 aa, synthetic construct
RLRYWPKLLKMLKKNGKVVWQRNLKTAASL

SEQ ID NO: 1191 - protein, 29 aa, synthetic construct
ILRLLSRFWKWLKKKLAAKDQLAFERLCK

SEQ ID NO: 1192 - protein, 39 aa, synthetic construct
KLKWMRRLYKWLPTKAEAKRLLTAICLNDRRARQGARDL

SEQ ID NO: 1193 - protein, 23 aa, synthetic construct
LLKFYSKFLRRFRRAFGTKWSLA

SEQ ID NO: 1194 - protein, 24 aa, synthetic construct
LMRLIRKLWKFFTCRFHLIKRRAL

SEQ ID NO: 1195 - protein, 42 aa, synthetic construct
KYKWYTRWYRFMHKHIKRLSRWAALQKIACKPARALLTLKRK

SEQ ID NO: 1196 - protein, 26 aa, synthetic construct
YIKLLRKLMRLFKQLKSSLCLADYRE

SEQ ID NO: 1197 - protein, 45 aa, synthetic construct
RLRFFTRLFKRFHCNFLALKRKREAEKHLRADQNKRREAMAHQLR

SEQ ID NO: 1198 - protein, 43 aa, synthetic construct
LLKLISKLFKKLHRKRVQLLKAAKRLPAMFYKYKVIARQKIVA

SEQ ID NO: 1199 - protein, 20 aa, synthetic construct
RIKWLNRLLRKMCHSRHLLN

SEQ ID NO: 1200 - protein, 60 aa, synthetic construct
LFKILKRLIRLLNCKAAKRHPKLLLKPLRRCAWNEMQKKEAYIREEFLPYATKRARTKVC

SEQ ID NO: 1201 - protein, 35 aa, synthetic construct
WLKLLPRLIRLMCRALKKRCMMWLLAFTQRRMHAN

SEQ ID NO: 1202 - protein, 27 aa, synthetic construct
YWKLLKRLLKRMPKAPYACAHKIHMAD

SEQ ID NO: 1203 - protein, 24 aa, synthetic construct
KWRLLQRFFKLLKHSKRHAKAALL

SEQ ID NO: 1204 - protein, 53 aa, synthetic construct
KFRLLSRLFRLLRRAIQWLMHEVDPAANSLRLALVKAKRFRKKAELVKACLKM

SEQ ID NO: 1205 - protein, 66 aa, synthetic construct
KIKLLPRLIRMLRKDPFKLMPRKFMRWTKRDVLWVDSWAKRQFSKLKRLRAVKEKRLLRALPILQA

SEQ ID NO: 1206 - protein, 79 aa, synthetic construct
RLRWLKRYIKIFNRRLKLAKKLAIRRSPAVALARPAMWFHLGGDARRQTTKPLLGYNDKKYCKVYSLKWYLAEIAKRKK

SEQ ID NO: 1207 - protein, 20 aa, synthetic construct
RFRLLCRFWKLMKRILKSLA

SEQ ID NO: 1208 - protein, 30 aa, synthetic construct
KLKFLCKFLRKWKRYRGPFLLHRPLLSIKC

SEQ ID NO: 1209 - protein, 21 aa, synthetic construct
LMKYIRKWLRKLQKERLCLVD

SEQ ID NO: 1210 - protein, 37 aa, synthetic construct
LLKMMKKLLRWIRSRFKRLLRPQWKRRIGEALFATDH

SEQ ID NO: 1211 - protein, 99 aa, synthetic construct
LFRYWKKLFRRIRKKRCLARALLSKSKLNAKCIKTALLHRLKLGLAAKYLALHALNRAIYCRSRLQPATNKKFAPVIFRMFLEHHLHKMKRKFTYSRNN

SEQ ID NO: 1212 - protein, 36 aa, synthetic construct
MMRYWKKLWKRFRCAMLDLKAVKRLLADKQVHATAC

SEQ ID NO: 1213 - protein, 86 aa, synthetic construct
RLKLYNRILKFLKSLHLLHAECASKRYLWNRLKKFKTRKKPCPKKGKAWNDGWIKKAMAIVKLARNPLLRRVRGAALLKAPKRHEF

SEQ ID NO: 1214 - protein, 39 aa, synthetic construct
IYRLIKRMWKRLRKKAMRLRIPFDRSAAEDILKLRAIFA

SEQ ID NO: 1215 - protein, 83 aa, synthetic construct
YLKLWKKMLRFIQPRTLEALALFSKWMVSAISKLRAKEKKGWAWMRIRIAAKLMRFFIAHEKKMNRAKAQSARLIARYYKKLA

SEQ ID NO: 1216 - protein, 82 aa, synthetic construct
FYRFLRKLFRILKRIQVKWIRKKMRRTALYRTQFKKKMLTTPFRALYYGILLRPKAKAKLLLASQTELYFLKLHFSLRLRKG

SEQ ID NO: 1217 - protein, 51 aa, synthetic construct
YLRLYKRWLRFFCNKLYTLRLNNRKEMQRARLSIAKCMNKVKKKRLAVKCA

SEQ ID NO: 1218 - protein, 40 aa, synthetic construct
MMRFLSRYLRMMQHKNRKLRKKALLIHDKRAHLDKSHKLP

SEQ ID NO: 1219 - protein, 69 aa, synthetic construct
LLKLLPRIMKKMRPLILWRKREKMGHDWLHFLWAPISPKEALNARVKGKLKDRAKCDNMWRKLAKLGRR

SEQ ID NO: 1220 - protein, 92 aa, synthetic construct
RMKFFCKLLKMLKQIRRKLKRARSRFNSKRQYEYAAAMKNKRKYAWAAAGPALSLKKILGRHAWKKKNWRWKTQAMFLKRHQLRLGLCRKAI

SEQ ID NO: 1221 - protein, 23 aa, synthetic construct
KYKLYKKIMRKLRHLAAQTDHLT

SEQ ID NO: 1222 - protein, 91 aa, synthetic construct
KYKMLHRLLRRYKTKMCRLNLLRHRSLNHARLANRNLSLWRKLSALFRTLLLAKKAAEMPNANFPDCIIDARVIKKRAPYKKYPAKIRRLE

SEQ ID NO: 1223 - protein, 46 aa, synthetic construct
LMRLFKRYFKRWKPWYFQLREVTLKKANKKVAKAAAKATEELRADK

SEQ ID NO: 1224 - protein, 20 aa, synthetic construct
RLRYLRRFWKYMHKRALSLL

SEQ ID NO: 1225 - protein, 65 aa, synthetic construct
KLKILQRLFRYWPRARFREKNSFLVTKCHQATRLYALARRNGHFNAKIEKANLGAKLALAELKLR

SEQ ID NO: 1226 - protein, 38 aa, synthetic construct
FIKYMKKLLRWYRKAWIARFQHLRDAEYKLAKNYRLLD

SEQ ID NO: 1227 - protein, 30 aa, synthetic construct
RFKILCKLIKLINKFKKEALPARATFQHKA

SEQ ID NO: 1228 - protein, 34 aa, synthetic construct
WLRWLRRLIRKIHHELLDRAKRPSIFLAKALAKY

SEQ ID NO: 1229 - protein, 46 aa, synthetic construct
MYKIWNRWLRLWKNLGLRRFAKALIHHARARDAKRKDLAGGLWAWE

SEQ ID NO: 1230 - protein, 35 aa, synthetic construct
LFRILPKMLRRLCHFVFKLAMKARAMKAAGRPHQK

SEQ ID NO: 1231 - protein, 29 aa, synthetic construct
RMKYWSKFLRWLTKPKARARDKEKLLFAA

SEQ ID NO: 1232 - protein, 49 aa, synthetic construct
LFRFIRKWWKKFNKAMAWSRPLKAILHLKCNRQRADALAVKARVWKHQL

SEQ ID NO: 1233 - protein, 36 aa, synthetic construct
LFRIIKKMLRKMTKPLKSFAEKNAKLRNLLRLRAYL

SEQ ID NO: 1234 - protein, 70 aa, synthetic construct
FLRLLQKYFRRLCRRRPYHDKARMIKLSEFKAHQASARRSLWGKCAATRQARRKLTVRGAPRKSMWAQKK

SEQ ID NO: 1235 - protein, 72 aa, synthetic construct
RLRILKRFLRRYKSRKNLAASTLLNRIPNLGLKAMAIQKNLMLARVAYGNPLALAWGCTGAFLKLKKQSCRW

SEQ ID NO: 1236 - protein, 87 aa, synthetic construct
IFKLFRRLFKRLPKRRKELLRVLMPGQKSKTAAKRKLPRGTIAVLKRMNWACWTSLPWARTRSRRCQLLRKCSKLKSKGAAAVPFLC

SEQ ID NO: 1237 - protein, 20 aa, synthetic construct
RLRLWKKYLRLLCKLGMRCQ

SEQ ID NO: 1238 - protein, 58 aa, synthetic construct
RYKFLHKLYRFLHKPEDQRLRGAIHWWATCLKALNRRLLQQGKFKAYALADKQLLRRT

SEQ ID NO: 1239 - protein, 72 aa, synthetic construct
RFKMLRRLFRRMKRKLITYKNAISGKTHQPLLRKRANTKIMLYKHKAFQKGRKGSEAKLLNAACWKALFARH

SEQ ID NO: 1240 - protein, 20 aa, synthetic construct
RWKLYRRLFRLISHAGALCC

SEQ ID NO: 1241 - protein, 47 aa, synthetic construct
LLKLMPKILRRFKSEYALLFMAIAIIKRILRIKKNHLLIAISRATWR

SEQ ID NO: 1242 - protein, 63 aa, synthetic construct
FYKLWSKFWKKLKSRLAEKRWRDVLLAYVRRRMKAGKQAARDIANLALAFARKWADTRDNLLA

SEQ ID NO: 1243 - protein, 30 aa, synthetic construct
KLKWLNRFLRKLCRWLKRLHKKRARHLLAY

SEQ ID NO: 1244 - protein, 20 aa, synthetic construct
LLRWLRKMLRKWKNELKWLA

SEQ ID NO: 1245 - protein, 30 aa, synthetic construct
FWRLIRKLLKRLHKQTKLKRSQAYAFRWWT

SEQ ID NO: 1246 - protein, 38 aa, synthetic construct
RLKLWRRLLRKLKQAATRLWNARRFNLDLKWRVYRLRK

SEQ ID NO: 1247 - protein, 94 aa, synthetic construct
KLRLYSRFFRFLKCAELCRFLAKRKKAQQARKSKRRVFQRRCSYSAKPRRLWSPALALNLLRCPCRKILSSLKKEGLRKRKLDQGKDWEQMLRE

SEQ ID NO: 1248 - protein, 21 aa, synthetic construct
KYRLLKKILRLLRKDQFALNK

SEQ ID NO: 1249 - protein, 23 aa, synthetic construct
RFKLFRRFLRLFTKENMAAVLNK

SEQ ID NO: 1250 - protein, 49 aa, synthetic construct
LLKLLKKFIRLFCRMEVKLKWTRGLVEGAAAAKRDLVWNALRRAVKACH

SEQ ID NO: 1251 - protein, 29 aa, synthetic construct
MLKLFRKWYRKFKPAALSCARFNLKSMFA

SEQ ID NO: 1252 - protein, 28 aa, synthetic construct
KLRLLSKMLKKYPKLSKKVQLLMLLKWW

SEQ ID NO: 1253 - protein, 52 aa, synthetic construct
KMRLMNRFYRKFKKVKLYQDRAEKRLAHTRPNAPQAKMKIVHAAAAPRKAKQ

SEQ ID NO: 1254 - protein, 28 aa, synthetic construct
LFKLFNKWWRILCQLQMDAARAKRLFKK

SEQ ID NO: 1255 - protein, 36 aa, synthetic construct
KLKIYQKLFKFLQHEARKRIAYLFACMCAITKRALK

SEQ ID NO: 1256 - protein, 44 aa, synthetic construct
FYKLLRKFFRKWRKRHNGRMADANALVWRLALKHRVAKNMKHSA

SEQ ID NO: 1257 - protein, 40 aa, synthetic construct
LLKFFTRWLKLMRRQFLRARVTDIGAAKIVRAAKTYYRNA

SEQ ID NO: 1258 - protein, 55 aa, synthetic construct
LLRLLCKLYRYWSTLRSRKAAEMDLCALLLRLHMVHLRDASRERRLRQHAMLEKK

SEQ ID NO: 1259 - protein, 41 aa, synthetic construct
IMRLLTKWLKKIKRACQFKKALLIRNAKNWRSLLCAQLLLY

SEQ ID NO: 1260 - protein, 72 aa, synthetic construct
RLKILPKFIRKLCRTCEIKRAWLKLHLAAKKRFKPAKHCMSKTPQTAAARHALRLHKQAFERCRPLTSYALQ

SEQ ID NO: 1261 - protein, 37 aa, synthetic construct
RLRLLRRFWKRYRHGLMALLALPKGMRKPAARDGLDE

SEQ ID NO: 1262 - protein, 88 aa, synthetic construct
LLRLFKKMFKFISRVRLGDLQRYYSRCARVVEAKAQALKYLVAYKYPFPSARRQDNKRRWAKLQCARSMAKGALRRKDLLRKDKMKIR

SEQ ID NO: 1263 - protein, 71 aa, synthetic construct
RWKLFTKFLKKMKRRLDLKAHDKKLLWALAANLGKPHKKALWLIDEAIDRLRYMLALINAVLQACRGWHAW

SEQ ID NO: 1264 - protein, 98 aa, synthetic construct
RLKFFCRLLKLLQCQKRIKRVGFLLEKFVRQKIKLVGGYLALRKRHRAKLRSSAEFNSVLAKFLAPIKLNSTKHAHAVRARDGRKQLLLKRPRHKIAA

SEQ ID NO: 1265 - protein, 74 aa, synthetic construct
RYRLFRRLLRRWQQTLKKEKGLYQLRLQAAFKPPQRCRWARHTLKEKALRLAFHNRLHGHTMKSWCAAALKHLE

SEQ ID NO: 1266 - protein, 61 aa, synthetic construct
RMRYFRKLLKKITCWAHQALVSLADRKHNEAAQPLRRKLYLKVAVSRFAWERLNLFALLRD

SEQ ID NO: 1267 - protein, 25 aa, synthetic construct
LMRFYQRFLRFLKHALFKDSALADR

SEQ ID NO: 1268 - protein, 50 aa, synthetic construct
KFKFIRRLFRWWRNCSRWPKELRLHAWLACDLKAAKLRLADKNKDLGLNR

SEQ ID NO: 1269 - protein, 23 aa, synthetic construct
RLRLFKRLLRLMTSKLLNATYSY

SEQ ID NO: 1270 - protein, 44 aa, synthetic construct
RMRYFRKFLRMFRCRVAFLAAQCRLAKYRRQKERKAYCLKLEAT

SEQ ID NO: 1271 - protein, 33 aa, synthetic construct
RLRLICKYLKLLRKHCLVKLKITFAKSNRKPLK

SEQ ID NO: 1272 - protein, 38 aa, synthetic construct
RYKMIRKLLKRFPRWFRLSKSKDMETVASLHLLAKKGL

SEQ ID NO: 1273 - protein, 96 aa, synthetic construct
KLKLMPKWWKILKRYVRMNALAYYRLDRKNDAAWEWAAFARIAQLKRKTWLRRIGKMRKALTKKAIFRRALMRKYKLTHSQKTHPAIKMWREEKAV

SEQ ID NO: 1274 - protein, 25 aa, synthetic construct
FWKWFHKLIKLLKKCNLHCYRKLLL

SEQ ID NO: 1275 - protein, 22 aa, synthetic construct
LLKWLHKYFRKFKHSLYALQKK

SEQ ID NO: 1276 - protein, 58 aa, synthetic construct
KMKMIKKYWKRYKKLRIAILERVREAKRRDLSVAVVGGKHLAPPRWLARSALRFLAAL

SEQ ID NO: 1277 - protein, 56 aa, synthetic construct
MYRIFSRMFRWLTPKTKKCALACALKRKKLALCWGRNKLVRDHRLARGYLWWKRRY

SEQ ID NO: 1278 - protein, 47 aa, synthetic construct
KWKYLRKLLRLFKRHLLLSYAQKHAKCINTGRKGRKKNICLAMHARR

SEQ ID NO: 1279 - protein, 33 aa, synthetic construct
RWKLLRKLLKRLKNRGQRLAKLTNMNNLWYTKT

SEQ ID NO: 1280 - protein, 40 aa, synthetic construct
KYKLFKKLFKWWCKLTILDDLAERALCNAHLMLPRHRDRK

SEQ ID NO: 1281 - protein, 75 aa, synthetic construct
YYKWLSKYMKRLKKCCHQTPARYTIAKLRHLMIKLDMPAALKLLDPNRRIARRTAQMRRRLRAAHAQLHKARNLA

SEQ ID NO: 1282 - protein, 74 aa, synthetic construct
KFKLLPKLMKKLRSLSPSRALIRLYMDFHNQLAKRARARLAGGLKVYKRPKLREIRAKVGLDLRYHVAWPLFDL

SEQ ID NO: 1283 - protein, 38 aa, synthetic construct
RWKMLRRWLKKMNKRKHSCWLVMADRALALIRCELADC

SEQ ID NO: 1284 - protein, 30 aa, synthetic construct
FLRFLHKLWKKIRRLARLTCLIQPKFCKVK

SEQ ID NO: 1285 - protein, 51 aa, synthetic construct
RLRYIRRLWRRIRHLKLNMALYCFRRLRELRAWHMAACLNKMTKRALAASR

SEQ ID NO: 1286 - protein, 51 aa, synthetic construct
RLKYFTKWFRKLKRYWKVKCKERKLCKFGTLNLRALELLALLLLFCLLGNR

SEQ ID NO: 1287 - protein, 30 aa, synthetic construct
KFRLIKRLMRKLKSVTKAEALKFHRQLAGC

SEQ ID NO: 1288 - protein, 37 aa, synthetic construct
LFKIYKRFYKKMRKRLSARLGLANAFVKRALTLVVSE

SEQ ID NO: 1289 - protein, 47 aa, synthetic construct
WWRFYPKLLKRLRKATHKIKGCALWPAAKDRAQMARAHGAGRRLALW

SEQ ID NO: 1290 - protein, 38 aa, synthetic construct
LFRLMQKLMKRIQKACLLRLKWAMLKAVRLEFWRYVNM

SEQ ID NO: 1291 - protein, 38 aa, synthetic construct
FLRFLKRLIKRFPKARDGMLRVQKTHAYFATAYAALWL

SEQ ID NO: 1292 - protein, 24 aa, synthetic construct
RMRLYPRLLRMYRRQMRAYLRANW

SEQ ID NO: 1293 - protein, 38 aa, synthetic construct
LYKWWRKLWKFFKRGLRKIAGLTTPKKARAILRTFANA

SEQ ID NO: 1294 - protein, 34 aa, synthetic construct
FLRLLQKLLRRYSKLKFCYLRESGCAIAARTWRM

SEQ ID NO: 1295 - protein, 38 aa, synthetic construct
LIKLFKKLLKLLKHKWRQAAAFRTHAKAVAATEWIWFR

SEQ ID NO: 1296 - protein, 40 aa, synthetic construct
RWKLFRKFLRKIKPIRDPAADHDQVAAGTKLQAFRLLLAC

SEQ ID NO: 1297 - protein, 61 aa, synthetic construct
RWKLMKRLYRLFRKNTLRLGLGVLREKLFALREKNKTRNGCRRSLMHNLAWGQRYLRKATR

SEQ ID NO: 1298 - protein, 34 aa, synthetic construct
RLKFLCRFYRKYPRHLTQCDSKAKRALARAYDLP

SEQ ID NO: 1299 - protein, 36 aa, synthetic construct
KWRLLRRLLKFFNRKLAQRLRQLAAGCRQLCRRMVT

SEQ ID NO: 1300 - protein, 28 aa, synthetic construct
LLKILRRWFRLWRHLTALARKDTLAKPP

SEQ ID NO: 1301 - protein, 21 aa, synthetic construct
MLRLLQKMFRRLHTDRLEAKQ

SEQ ID NO: 1302 - protein, 59 aa, synthetic construct
YMRILKRWWRLWRCLKKHRLAACCMLTRLLLNLKMKEVMGECQKLKKTGKLKELAEKER

SEQ ID NO: 1303 - protein, 42 aa, synthetic construct
RMRLINRWIKILHKRRRNLLAGKLIWVLRIDLVCARNLAKWL

SEQ ID NO: 1304 - protein, 27 aa, synthetic construct
KLKWLSKLIRKLPKKWIKAKCAAYCIF

SEQ ID NO: 1305 - protein, 46 aa, synthetic construct
KYRIFKKLFKRWRRARWDMRPFTRQILLLLGPFRRQITAEKLRAAL

SEQ ID NO: 1306 - protein, 42 aa, synthetic construct
KMRMLTKYIRKWKRLLHHRIKHKGLRLCECWALRALADAPRR

SEQ ID NO: 1307 - protein, 85 aa, synthetic construct
RLKFLRKMFKRIQPEKALQKTWAKKAAVLRWTRAKDAPRALGITKLQWAYLARPVKHKWRFLATCRCALRINKLVPDKRRNALVR

SEQ ID NO: 1308 - protein, 23 aa, synthetic construct
RFKLYTKLYRRMTKSALAQLQPR

SEQ ID NO: 1309 - protein, 46 aa, synthetic construct
MFKMLKRFLRKYKNKSIKRTDKIVLAILATIAFVKLLAKAKLAAGW

SEQ ID NO: 1310 - protein, 41 aa, synthetic construct
KLKMFCRLLRRWKCRRACKCIRRKNSARSWHKALALKLPLA

SEQ ID NO: 1311 - protein, 31 aa, synthetic construct
WMRLMCKLLRMIKRKNQKTLFLRMPLLRRKA

SEQ ID NO: 1312 - protein, 23 aa, synthetic construct
LLKWLKRYIRKLKKHMAASRKLM

SEQ ID NO: 1313 - protein, 27 aa, synthetic construct
KLRLMRKLFRFIHKKRLDWKRNALLLY

SEQ ID NO: 1314 - protein, 27 aa, synthetic construct
KFKLMKRWLKLLKSDFPRPSAAALINK

SEQ ID NO: 1315 - protein, 25 aa, synthetic construct
LMKLFRKMLKLFRHRAHTLLIMNRD

SEQ ID NO: 1316 - protein, 40 aa, synthetic construct
RFKILKRIMRFFKKKPKCLAHLQRAAKLASFQWARNLKAC

SEQ ID NO: 1317 - protein, 36 aa, synthetic construct
LLKLMKRFFKKLRNASVYMRAHMIYMAARLKRAYWY

SEQ ID NO: 1318 - protein, 73 aa, synthetic construct
MWRLLCRYFRKLRRRPLAGLDRLFLKKPGSMIAHASHAAKGNGKKRLRCRFLRHPYRCKKRLLAATLLVSAYH

SEQ ID NO: 1319 - protein, 27 aa, synthetic construct
LMKLIKRFLRRWHRVAIRHRIERWAAA

SEQ ID NO: 1320 - protein, 42 aa, synthetic construct
RWKFLRKYLRILRRGTAYAKLRIADAHLLQGLRFRLYRLHTL

SEQ ID NO: 1321 - protein, 40 aa, synthetic construct
WMKLLRRLMRRLTPRVRWKDLARLRMLLIKERMNQVVALW

SEQ ID NO: 1322 - protein, 31 aa, synthetic construct
RLRWLKRFWRRICRLALMLIRHDRNVGAKGL

SEQ ID NO: 1323 - protein, 74 aa, synthetic construct
RYKWFKRYLKKWKRAELPLLYSARAKRNYVAPLKCVQGYRLLIAKVAERQWRSKLNAGHKRAPIPDLAELRLAA

SEQ ID NO: 1324 - protein, 36 aa, synthetic construct
LLKLLRRFFKIMKKYCVLNDRKWHARVLKILVPLWA

SEQ ID NO: 1325 - protein, 44 aa, synthetic construct
LYRWFKRFFKLMSRAFRLKKALARQSCKSKAVPQALGLAAHFLE

SEQ ID NO: 1326 - protein, 75 aa, synthetic construct
KYKWFKKLWRWLRHSPPLYCRAKCKFKERLVKKADRLLILACTALDKRLRAVFAEIFIFMTKHLLECKLIKALAR

SEQ ID NO: 1327 - protein, 70 aa, synthetic construct
KLRFYHKLLKIYKNRIARAAQAQRKYRLLQEGADMDKIRGVLLQLLLAPSNWKLRKRLVLVAKTKKDHWA

SEQ ID NO: 1328 - protein, 29 aa, synthetic construct
LFKIFKRLLKRLRRSCDAMGFMRIREAAN

SEQ ID NO: 1329 - protein, 34 aa, synthetic construct
KLRMLQRYYKFFHRNRVPARPYLRDAAHARLKQR

SEQ ID NO: 1330 - protein, 49 aa, synthetic construct
KLKYLRRWFKKLKPPLLLYRTRLKFRATAMGFCAKKGAPNITRAWESKM

SEQ ID NO: 1331 - protein, 60 aa, synthetic construct
LFKIWNRMFKKLHKMADHIERKKKKRTRRNTKAYYNLKLLRDAKLAERHVLKNAEPLYAY

SEQ ID NO: 1332 - protein, 21 aa, synthetic construct
KFRILHKLYKKLHTFVAKLAH

SEQ ID NO: 1333 - protein, 55 aa, synthetic construct
KMRLLKKFFKLLKTRIMRLRNMKLQLAKKKFQIKARLLLESMHLVADNANLRYVT

SEQ ID NO: 1334 - protein, 34 aa, synthetic construct
KLRLMKRLLKKMQRWALADPRSLGAARTKWNSRK

SEQ ID NO: 1335 - protein, 22 aa, synthetic construct
KIKLLCRIYRKWKKRALVTAIA

SEQ ID NO: 1336 - protein, 41 aa, synthetic construct
YWKLLQRFIKRFRREIVLKGNGLKNKKLIKLALSTQLHLRK

SEQ ID NO: 1337 - protein, 40 aa, synthetic construct
RLRWLKRWLRRYRCEGYRATSKGIHFLKKLAWMKLAQTLC

SEQ ID NO: 1338 - protein, 59 aa, synthetic construct
LLKLFRKFLKRIRKKYQCTAAALALDKWAISGPKAFHKKRKVSLTCLGKHMRLGAKEWL

SEQ ID NO: 1339 - protein, 30 aa, synthetic construct
ILKFLTRIWRLMKKAKARAARMLDRDATQV

SEQ ID NO: 1340 - protein, 50 aa, synthetic construct
LLRFWRRLMRWYQRAKMAKRCRYQQLVALKNLFQLRAKRNAMIRCRALMI

SEQ ID NO: 1341 - protein, 74 aa, synthetic construct
RMRLFNKLMKFLRKKGMYRLAPHGKAYPNLRLRLYRRIKKARRKASRYKQIKYDTLLYFLDWPGNGARYAEAKR

SEQ ID NO: 1342 - protein, 70 aa, synthetic construct
KIKLLKRLMRRYPKLRTECWPAHRKKAAESKCLHLLYLAQKGNSNKAFAWRLKFPAKWARDRHGHALARQ

SEQ ID NO: 1343 - protein, 72 aa, synthetic construct
ILKMLRRWFKFLKRRQFSLFCRLACYTKLHICRRLRKETIMEKAFRACMGLKLPQSLHLDAPKALKAKAIKK

SEQ ID NO: 1344 - protein, 25 aa, synthetic construct
KMRYFCKLLKLFNRRVARQARVHSL

SEQ ID NO: 1345 - protein, 37 aa, synthetic construct
FLRLIKRWFKRFRNVKCHAFLAARKIHNWLRLKLALS

SEQ ID NO: 1346 - protein, 28 aa, synthetic construct
YFKWMKRFIRWMKKNLALTANDLLLLRR

SEQ ID NO: 1347 - protein, 31 aa, synthetic construct
KLKFFNKMIKRLNKPWRQLRACIAKIARAAQ

SEQ ID NO: 1348 - protein, 21 aa, synthetic construct
KLKLLRKLLKKIQTSYCAECC

SEQ ID NO: 1349 - protein, 20 aa, synthetic construct
WLKILSKLYKLWCCLALHRK

SEQ ID NO: 1350 - protein, 20 aa, synthetic construct
IYKLICRLLRRFKHNALNLA

SEQ ID NO: 1351 - protein, 83 aa, synthetic construct
RFRILKRLYKWIRCLIALWILRAVKAKAAAVKPQCLAHAANGWRSKMDACGQAWLQRLKKMTKNKCAWLRMKRRKLRNQKKKD

SEQ ID NO: 1352 - protein, 26 aa, synthetic construct
RWRLLNKLMRIWRKACRAKAPHLYWI

SEQ ID NO: 1353 - protein, 50 aa, synthetic construct
LLRYYRKWMRKFRTACAALANKIYKFLTCDAGKAKIAQKMHMKKRACRLS

SEQ ID NO: 1354 - protein, 28 aa, synthetic construct
RYRFYKKFFKRLTRWEAFAQRALCNALR

SEQ ID NO: 1355 - protein, 31 aa, synthetic construct
LFRYLRKFLKWFRKVKELARCKLLREAPPGD

SEQ ID NO: 1356 - protein, 28 aa, synthetic construct
KLRLFNKMLKLMCKARLNYMKGCIREAK

SEQ ID NO: 1357 - protein, 28 aa, synthetic construct
LYRLLKRIMKYLPRQKEALRTVNWKKLQ

SEQ ID NO: 1358 - protein, 60 aa, synthetic construct
FWRYYRRWLRIFKKYTHRKTLRRMCNALNKKRVAKLKLAASFSTKDDLRALPRRVLTGLK

SEQ ID NO: 1359 - protein, 28 aa, synthetic construct
RIKILTRLLKMLRKNLRLLLKPKLSKLF

SEQ ID NO: 1360 - protein, 32 aa, synthetic construct
LMKWLHKLLRLFKPKFVRKMRNAAVWKHLLMY

SEQ ID NO: 1361 - protein, 29 aa, synthetic construct
RLRILTRLLRILTRAAEMCRKLGQHLKRW

SEQ ID NO: 1362 - protein, 63 aa, synthetic construct
KLRLLPKWWRRFKRLSRLIILPPWLWMGADRLRASEMLLLVPRRQIKNSPKKARTAKFRRRVD

SEQ ID NO: 1363 - protein, 34 aa, synthetic construct
LYRLFQRWFRLFTKAIKVALFEHRIRLWKAKKLS

SEQ ID NO: 1364 - protein, 40 aa, synthetic construct
KMKFYRRYFRLLCQRRQAVFRILLKLKHARCHKQLCLKWF

SEQ ID NO: 1365 - protein, 58 aa, synthetic construct
ILRWLQKYWRKFRRKIMYGLINKSALCAIKKARAFDNVELAAAHKKKAKALLSSNMRA

SEQ ID NO: 1366 - protein, 40 aa, synthetic construct
RMRLLRKFYKLFKKLVERADAKISYKMFRLVRLQAGWKGM

SEQ ID NO: 1367 - protein, 27 aa, synthetic construct
RYKLLQRFMKRMRKRALLLQKVIARAL

SEQ ID NO: 1368 - protein, 34 aa, synthetic construct
RLKLFNRFMRRYKRNACAYCYRKLDDLAEQRAWA

SEQ ID NO: 1369 - protein, 30 aa, synthetic construct
LIKMLKRFFKFWKRPMGCWLAQRLLKKRFL

SEQ ID NO: 1370 - protein, 32 aa, synthetic construct
WLKFLSRLLRRWPCELAFKVPKLQRCSQLKKA

SEQ ID NO: 1371 - protein, 30 aa, synthetic construct
YFRLFRKYLRLFQQAENRPLRRSRKLDALF

SEQ ID NO: 1372 - protein, 34 aa, synthetic construct
LFRFISRFFRRIRKPRAILWARKAAAAQNLTARK

SEQ ID NO: 1373 - protein, 95 aa, synthetic construct
RWKYFKKLWRRLRQLSAKDCKANRSANRKLPYWRVAKKMLARLRRAFGLHVRRPALTYAPFTAPRIWKLVIERLLKEAPFTFATKALKQKWKREW

SEQ ID NO: 1374 - protein, 20 aa, synthetic construct
IFKFLKRFMRKFKKVAAAPA

SEQ ID NO: 1375 - protein, 59 aa, synthetic construct
KFKWLQRWLKLFKKRHKLYLCDLLALEKRHHDVERKKYLPRGRAIKAAHYRIIALTKNM

SEQ ID NO: 1376 - protein, 60 aa, synthetic construct
MLKWFRRLFKRLRQESSRSVSAHAIYWKRRRKALKLQDYAPANLARLSKWSFKKERLAQQ

SEQ ID NO: 1377 - protein, 30 aa, synthetic construct
KLRLYKKILKMLNRHLQKLIVCHLTKALVL

SEQ ID NO: 1378 - protein, 30 aa, synthetic construct
KMKLFTRIYKLLCQCKDELKRKKAGWRATL

SEQ ID NO: 1379 - protein, 40 aa, synthetic construct
LLRFLRKLLKWIKKAYAYRQEQTLERPILFRAILRLRYKV

SEQ ID NO: 1380 - protein, 92 aa, synthetic construct
RFRFFQRWLRRLRSRLRAQKKKLWSDIWFHPELSHLINAKGAHRERAALRLKKLCRVTADTKRNRTWLRLKLKRKTNALRDRRLAKLVWLFL

SEQ ID NO: 1381 - protein, 63 aa, synthetic construct
LMRYYQKFLRKYQCKRRKARVSLAACAVLYGAHYAVKLRFCARKAKVKKNQAAIRSALKAARF

SEQ ID NO: 1382 - protein, 59 aa, synthetic construct
LWKWLKRLLKFFHRVAPKEGARQKRMKHLRIELAAMPRKWQSAADLIALAKILTACALR

SEQ ID NO: 1383 - protein, 64 aa, synthetic construct
MWRLFRKMLKRLKRIKKAARCILDRYIAYLVKKPCAQQEKAELEKLENGPLRMAKLHWVKYAKK

SEQ ID NO: 1384 - protein, 45 aa, synthetic construct
LWRLLRRFLRYWQKVIKVRVAFIKKLAKACLRTDKAAKTRPLFAH

SEQ ID NO: 1385 - protein, 30 aa, synthetic construct
RLRLITRLYRKWCRSALNNKMKGLTYAGKK

SEQ ID NO: 1386 - protein, 96 aa, synthetic construct
KFKYMKKLYKKYTQKQRLKPPRLLGRWKACNKRIEREWLVMLKAAARTAKAYKLRHVLEVARSLVKKHELTGFAKRELFLKLADISKHLLQYRRCT

SEQ ID NO: 1387 - protein, 20 aa, synthetic construct
LLKYLTKFLKRLHKAKAVRR

SEQ ID NO: 1388 - protein, 30 aa, synthetic construct
RLRWLRRLLKIFRTAAASMFCALTCHERDR

SEQ ID NO: 1389 - protein, 20 aa, synthetic construct
KWKYYKKWLRKLNNALAKVA

SEQ ID NO: 1390 - protein, 27 aa, synthetic construct
IIRLIPKWYRLFTKLYLRGARKAKDIA

SEQ ID NO: 1391 - protein, 27 aa, synthetic construct
LLRWFKKIMKLLKRKAGLKSTQNLQRA

SEQ ID NO: 1392 - protein, 60 aa, synthetic construct
ILKFLQKIWRRLSSIRLMRKILKAICRLAARKWSPAKKIREGWGQKAKPKVSLHRRSLAR

SEQ ID NO: 1393 - protein, 75 aa, synthetic construct
KYKFLSKMMRYLKSARAAAGLVAIITKTRAALRSREALLLKRRQATKLWAPKLYLKRFLKPLRRFILTVYYEAFK

SEQ ID NO: 1394 - protein, 62 aa, synthetic construct
KFKLWRRLFRRIHKMGLWVLKMIAKLYQLLWQRAEMKAAKLKKRPHTHLWYTAMSCKRAALA

SEQ ID NO: 1395 - protein, 33 aa, synthetic construct
RLKFWPRYMKMLKKFMKARMNKHRAAKLDLTLS

SEQ ID NO: 1396 - protein, 73 aa, synthetic construct
KFKWLKRWYKLLKKHIIWELLLLDTLAKRAAAYAALIAARKRYWQFYTAAEKWKRNDARAHSTKKRLIRTRVY

SEQ ID NO: 1397 - protein, 37 aa, synthetic construct
MWKMLRKLYRRIRSDKAKLAIALRQSVLNDKDQRATR

SEQ ID NO: 1398 - protein, 20 aa, synthetic construct
RIRLLRRLFRRMSQCFLKLL

SEQ ID NO: 1399 - protein, 37 aa, synthetic construct
MFRLIKKIMRFFKRADAFACNRRARSALAFKFSRAWL

SEQ ID NO: 1400 - protein, 32 aa, synthetic construct
FMRLLRKLIRKLQRAQPRWCWSRNCAAALKLA

SEQ ID NO: 1401 - protein, 69 aa, synthetic construct
YMKIFRRLLKIMRSLCLLRPKVLTKLWFAPQLKARRCKGQRCRELKAVRQLLWNKRKAYLIDNLKKDAM

SEQ ID NO: 1402 - protein, 64 aa, synthetic construct
LIRLLQRMLKKMQRYKCRSLKLLLMLLRKLLGRRTDNLSRVVRAAVYHGVRRDAWAYGTYKLRT

SEQ ID NO: 1403 - protein, 40 aa, synthetic construct
YMRLLRKWFKKIKRLASTRKVKLKGAKQVAKFPYLDLWQY

SEQ ID NO: 1404 - protein, 44 aa, synthetic construct
KFKFLRRFMKRWRKLRKHSSALKYRVVRRIPLATALIAVREAPA

SEQ ID NO: 1405 - protein, 38 aa, synthetic construct
LMKFFRKWLKRLRKRPRCHQRLTLKLCQAYRLNLVVTS

SEQ ID NO: 1406 - protein, 32 aa, synthetic construct
RFKYLCRYWRKLKCRRERIAQCLPRLHQAAAW

SEQ ID NO: 1407 - protein, 70 aa, synthetic construct
KLKYFRRYWKRIPRLRAAALRQAKDTWVGRLLIATIGLKRMATSAALDHRVLKAKRRKNHKGKCLCHACR

SEQ ID NO: 1408 - protein, 100 aa, synthetic construct
KLKMFRKMFRKYNTCGLLKYRSRDAHTRMLIAKLARCAKIAKKALLLFQTPAASKDLKHLMFFVLLGLLARKARNQCRQFLANHNAYVRLKKKADRAHEM

SEQ ID NO: 1409 - protein, 61 aa, synthetic construct
KLRILRRLIKKMKRENGRLRRKLCAMYLRRYVTARNAWMVADKKTAYTRWKEAAYTSAAAR

SEQ ID NO: 1410 - protein, 33 aa, synthetic construct
KLRLMQRWLKLLKKSLYWKWDIQAAKLDRKILV

SEQ ID NO: 1411 - protein, 60 aa, synthetic construct
LFRLYHKWLRYYKTILYLLGWMHKRRHKRNLALLLKHRKKMSARKAVAAWFSKPAWSQIA

SEQ ID NO: 1412 - protein, 23 aa, synthetic construct
LFRIFNKLIKRYRRLGAAKKAFW

SEQ ID NO: 1413 - protein, 32 aa, synthetic construct
LYKILRRLFKMLRHQADYAVKVRARCKPMPLR

SEQ ID NO: 1414 - protein, 29 aa, synthetic construct
LLRLFKRFFRWLPREALAVGLTRHKKKRL

SEQ ID NO: 1415 - protein, 21 aa, synthetic construct
IMRYFRRLLKLYPCRKLARHH

SEQ ID NO: 1416 - protein, 72 aa, synthetic construct
KYRLFRKIYRRYRRGATKVNRGMFLDLKKQRWALLQARILALFRRKKFPRHGHLKLTTALLNNALLCKSHAL

SEQ ID NO: 1417 - protein, 26 aa, synthetic construct
RYRFLHKWFKLFKPLAHYKYLKVRAA

SEQ ID NO: 1418 - protein, 20 aa, synthetic construct
MFKMLHRLLRMLCRMYRKKA

SEQ ID NO: 1419 - protein, 58 aa, synthetic construct
ILRLLKKIWKKFPKADGVARGDRLGWVKMPIALAKLDKNEHRLARKHRKRLLRIKSFY

SEQ ID NO: 1420 - protein, 35 aa, synthetic construct
RLKYLSKWWKLLKKFAKARTLRCAADPEDICKLHA

SEQ ID NO: 1421 - protein, 22 aa, synthetic construct
LWRLLKRFLRKLRKKFYSLMMA

SEQ ID NO: 1422 - protein, 55 aa, synthetic construct
YWRYFPRLLRRLKKEAALKLTRARKLCVLTLKLAFLERFKYLAKALQKKALEGRQ

SEQ ID NO: 1423 - protein, 41 aa, synthetic construct
LFKLYQRMMKKYKRLLKERTWALCRKTGMRKEGMRLLAWGL

SEQ ID NO: 1424 - protein, 30 aa, synthetic construct
FYRLLTRLFKKLHRRLYRKFSAQRWGVATL

SEQ ID NO: 1425 - protein, 69 aa, synthetic construct
RWKLLKKLLRKFKKCGITHMTRNHLLHKARNANGRRVLIWRVKLIIFVAALRIAGKKLKKSFMNRVKLA

SEQ ID NO: 1426 - protein, 38 aa, synthetic construct
RLKMLPRLLKIFSKKDVLQLNAYAGLHHKQWKRKTRAL

SEQ ID NO: 1427 - protein, 21 aa, synthetic construct
WLKLFQKLLRLYKKFLRLAYR

SEQ ID NO: 1428 - protein, 67 aa, synthetic construct
RLKMLNKLMRRFQRAAIGRVPELKTKKGIKLSFWKRRTPLVRARLFCNAIPLAAALGQKQLARARAK

SEQ ID NO: 1429 - protein, 32 aa, synthetic construct
KFKILKKWMKKINPLWKMAACANRATCLRIAL

SEQ ID NO: 1430 - protein, 33 aa, synthetic construct
KLKWLKRFLRKYRRLQLKCATLLHYKWWDMKWH

SEQ ID NO: 1431 - protein, 23 aa, synthetic construct
MIKMLRRLIKKIKKLFALARNAD

SEQ ID NO: 1432 - protein, 48 aa, synthetic construct
ILRMLRRLYRKYSKAGAGLERKYWSNLACAHKLLNLRWRADWMAFPRA

SEQ ID NO: 1433 - protein, 33 aa, synthetic construct
LYRLLRRLLRKYRTPDPVLWARYLLVPRDNRRT

SEQ ID NO: 1434 - protein, 71 aa, synthetic construct
FWKFLRRFWKWLKKGKTLAYALLKYADKRRQAARMRNHWTAQIKKKAWALYALASSKLMAGCLEKAYKKLT

SEQ ID NO: 1435 - protein, 21 aa, synthetic construct
LFKIWKKYLRYLRKAATYKAM

SEQ ID NO: 1436 - protein, 42 aa, synthetic construct
KLRMWQKMLRRFRRLRAQFSFRARDRAKAALQCMQQKLWAKR

SEQ ID NO: 1437 - protein, 42 aa, synthetic construct
RLKLMTKIWKRYKKCLRKLRKTNAWAAARKLRLQLKAEWFAG

SEQ ID NO: 1438 - protein, 22 aa, synthetic construct
KLKILCKLLRRYKTWASGALAY

SEQ ID NO: 1439 - protein, 27 aa, synthetic construct
RYRLIKRLMRLMTRRLRHLAGAPAAAC

SEQ ID NO: 1440 - protein, 36 aa, synthetic construct
RLKFMKRFWRFLTKTKEIHILRARTRGLLRAAMLAR

SEQ ID NO: 1441 - protein, 33 aa, synthetic construct
LLRYLRRMLKKLPPRRAELQGKHARHCTDKCPR

SEQ ID NO: 1442 - protein, 39 aa, synthetic construct
LIKYYCRYLRRLKSKALRTAWFTKCKSRNKLRKLAAALI

SEQ ID NO: 1443 - protein, 32 aa, synthetic construct
LFKLLKRIWKLWKNKTLLKLKRMLLEDLRWSK

SEQ ID NO: 1444 - protein, 39 aa, synthetic construct
ILRMLKKLWRFLQKRNNMSCRKNAPAKIFLLAPFAGAAR

SEQ ID NO: 1445 - protein, 20 aa, synthetic construct
KLKLFKRYLRRMNQNAATQA

SEQ ID NO: 1446 - protein, 42 aa, synthetic construct
FFKLWRKWFRKWKNRLRLLVLKAKMRMYVAMCLKPIYAALRS

SEQ ID NO: 1447 - protein, 83 aa, synthetic construct
RLRLYRKLIRKLHRSALLMWDRLGNSPHAAAILQAARPDFLCAYKNLPSGKPRLAREGDTPRRLAAMEKHVRRAEAKLKVALV

SEQ ID NO: 1448 - protein, 82 aa, synthetic construct
RMRIFKKFLKKFKKIAALKKVRWALLLKSEWKRIAKFNPLDMAYHQMWCLPLGRSAKRRAFEGAAKLAALALCEDRAVDRRA

SEQ ID NO: 1449 - protein, 27 aa, synthetic construct
LIKLMRRWLKKYQTPLAKLQDSALQKW

SEQ ID NO: 1450 - protein, 56 aa, synthetic construct
RIKLFKKLFRLWHPRQMNAPKIIWVKKAADGCLAIAKKKPMKHQKKLLALKLPFKL

SEQ ID NO: 1451 - protein, 45 aa, synthetic construct
RIKIFRKLWKLFRHQCLLYAKGRERHTYFRAQVNRAKLAAHKKLP

SEQ ID NO: 1452 - protein, 78 aa, synthetic construct
RYRFLKKIFKRYTSCAKVKPKAAPHAKNRRRLRKRLLRRIPAKKKLALHAAMISDASKQAVLAADKRAAMMANHRQTK

SEQ ID NO: 1453 - protein, 45 aa, synthetic construct
RWKWFTRFYKRFRRRARSELRIAKKRNLDLLLLPAQPLRIRTLTI

SEQ ID NO: 1454 - protein, 29 aa, synthetic construct
LLKYFQRMLKIYKSWAGWLQLLMRNKRKA

SEQ ID NO: 1455 - protein, 61 aa, synthetic construct
RLKMFKKFLRLWRKHACKSLAEGWLSRHEWRMGRRLDKSKPEEAKKADRAKLKLRILYMYS

SEQ ID NO: 1456 - protein, 30 aa, synthetic construct
RLRLMTKLYKRFRKKPLALLLMRAYGINKK

SEQ ID NO: 1457 - protein, 56 aa, synthetic construct
ILRFLKKWFKRFKRVRHKMILMRGAMGIWTARRAAAKNYKRMLLVLGAGVKARRHC

SEQ ID NO: 1458 - protein, 86 aa, synthetic construct
LIKFLKRIIKRYKSLALLRCRYIWILIRATLTCKHRAKSQEAGLGNRKEAKARWHARRKNKQGATRVRVAHKKTAVAKLIVLGGLK

SEQ ID NO: 1459 - protein, 43 aa, synthetic construct
LYKFLRRMMRKLKHRILIKFVWRNTPAQALKKHRAKRLTALHL

SEQ ID NO: 1460 - protein, 40 aa, synthetic construct
FLKLLCKWWRLIKKLCRKLRFHRAKATLGAWPLKQKTVFP

SEQ ID NO: 1461 - protein, 88 aa, synthetic construct
FFKLLPRFLKWFQTAESRLSAAKKLTWAALLKKVRLKMKANKKWWLLKLALPGHFWAFRHKLDEWCTNKAMCRKSRILIKEGRHLARK

SEQ ID NO: 1462 - protein, 22 aa, synthetic construct
LLRFIQRLIRKLPKRCCLASQA

SEQ ID NO: 1463 - protein, 62 aa, synthetic construct
KIKLMTRLFRLLPRTKQAFAVAYPLWAAAQKRKLCKAALPKAHKHAIARFLVKQLSKKAKKL

SEQ ID NO: 1464 - protein, 72 aa, synthetic construct
MIRFLHRWIRKWKKEVLQWKKAKAWANARAHAHYRSAKHLKALAHWRLWRAALELHTKLKIQAHMGRMLAKM

SEQ ID NO: 1465 - protein, 47 aa, synthetic construct
KIKILKRLFKWLRRLSGADLKANDNAKACAHGQRLAQYAQLHMANKN

SEQ ID NO: 1466 - protein, 84 aa, synthetic construct
LLKWFKKMYKLFPPMLTRRRKRKMKNKDAGALVHGIRRRDARLIWRVLTMAALEARKKMRLRRGRAFAQCFRKAAHGLACLKCM

SEQ ID NO: 1467 - protein, 22 aa, synthetic construct
RYRLWCRYFRFLSKRAFLLARH

SEQ ID NO: 1468 - protein, 26 aa, synthetic construct
KYRMLSKMFRLIRKLKGNKLNVAAGA

SEQ ID NO: 1469 - protein, 22 aa, synthetic construct
FFRMFKKFLKRLNCKLAALRLH

SEQ ID NO: 1470 - protein, 23 aa, synthetic construct
RLRIIRRYWKWYKRLCLAAHLLS

SEQ ID NO: 1471 - protein, 50 aa, synthetic construct
RWRMFRRLFKIFHTQRGLAEISCLKALCRLRNALKADRKAKGEPKAMRKH

SEQ ID NO: 1472 - protein, 51 aa, synthetic construct
RWKWYCRFLKKFPSLKKANLWLKNLAYRHWRLAYKLRITRTADAILCRLKR

SEQ ID NO: 1473 - protein, 27 aa, synthetic construct
MLRLFRRLIRKYTKAKLLCFERPAKLR

SEQ ID NO: 1474 - protein, 23 aa, synthetic construct
RLKFFKRWWRKLPQAARAARNND

SEQ ID NO: 1475 - protein, 40 aa, synthetic construct
WYRLLRKFMRMLQCLSKFIAIFDLRLLAASKFGKRKPFRA

SEQ ID NO: 1476 - protein, 29 aa, synthetic construct
LLKILKRIYKKLKKALQRMGHRMTGLIAT

SEQ ID NO: 1477 - protein, 32 aa, synthetic construct
KLKFWRKIFRLLKPAGLSTADLRAKKRNNGKS

SEQ ID NO: 1478 - protein, 63 aa, synthetic construct
KFRIINKMYRWLRHLAKKLRWRQKWKWAAAKRWAKRLDPRWWDKRVQLLRMKAECAEGLACGE

SEQ ID NO: 1479 - protein, 21 aa, synthetic construct
KFRLLRRMLRLWKRSFMQAAA

SEQ ID NO: 1480 - protein, 28 aa, synthetic construct
FWKLLRKLFRWLNKLARFMEAKPRLKRH

SEQ ID NO: 1481 - protein, 49 aa, synthetic construct
KLRMMRRLWKRLQRRYAYLALASELRLGNWKWNSELQSPIRCKKAKLFK

SEQ ID NO: 1482 - protein, 37 aa, synthetic construct
RLKYWTKILKMLSKYLLEKAHAATRNTCRRKAALAKW

SEQ ID NO: 1483 - protein, 41 aa, synthetic construct
LIKWIRKIFKRFPRSKRRIAKAYLKKRAAASRLSGLQINAV

SEQ ID NO: 1484 - protein, 86 aa, synthetic construct
KWRLLRKMLRKLRTKKASAMAWLAAASLSCKERLNWVECKQGLQCFFCIVKIGAKLYKRHTLKAKKQDKNKDLAKMDQRMRAILKR

SEQ ID NO: 1485 - protein, 20 aa, synthetic construct
KLKFYKRFLKMYQKRLQAAS

SEQ ID NO: 1486 - protein, 32 aa, synthetic construct
LFKLLCKLLRRFSRANLRMRGMLRLKKFCMYQ

SEQ ID NO: 1487 - protein, 65 aa, synthetic construct
LYRLIKKIFKLLTSAKSNSWLFAKFLWLKLNKRRKKMLILKNLARQWGKLFKCAKLLFAAICALV

SEQ ID NO: 1488 - protein, 50 aa, synthetic construct
FYKLMCKYLKLIRPHAAKRKQNAAKHAAKYYTRKLADMQLWYLKPKLRVY

SEQ ID NO: 1489 - protein, 47 aa, synthetic construct
RIRLLRRLLRYITRKRSAIKVYAMKAGIMGARHKCYWKLQLELKIPL

SEQ ID NO: 1490 - protein, 38 aa, synthetic construct
RYKLFKKWLRRMRNDRDAPQALLCLLLFAFKQERFLVW

SEQ ID NO: 1491 - protein, 96 aa, synthetic construct
LIRYLRRLLKLFKKALGHAKKYQMWLALDGFRQNWYKHLREMKQLMQKAGKKFCKVTRRKAAVKKIQELKKLNFAELKKRVFREYLKYCRAWKFHL

SEQ ID NO: 1492 - protein, 29 aa, synthetic construct
YIRYLKKLLKRFSKLLIMDATLALQKPAK

SEQ ID NO: 1493 - protein, 26 aa, synthetic construct
KLKLLTRFFKLWSTRKRLLIFIKRAI

SEQ ID NO: 1494 - protein, 30 aa, synthetic construct
RIKLIKRIFRRYRKRRLLFDAELAKLAMVV

SEQ ID NO: 1495 - protein, 74 aa, synthetic construct
WFKLFCKLWKKIKSQEALITAWLRKALKTPICKKLRADARARARWRALFRHGKVNLNCKLRRYATGAPKQLMHQ

SEQ ID NO: 1496 - protein, 52 aa, synthetic construct
MMKILTKYLRKMNPLLDFILASKKYRRWVLPQVLSSALRLLKKGARKKALRA

SEQ ID NO: 1497 - protein, 42 aa, synthetic construct
RYKLLKKLIRIFKKKTLAKLADYLRRKAQPARMGNVLGLHNP

SEQ ID NO: 1498 - protein, 40 aa, synthetic construct
YLRLIPRFLRYLKKRIALIRFRSGYAKARIKNALERLVLG

SEQ ID NO: 1499 - protein, 67 aa, synthetic construct
FFKLFPRLLKRLKNHEGLNCARHARLLITAVPREAQMGKKPARRLQGRKLRRQSGGAYKAAYRKWKQ

SEQ ID NO: 1500 - protein, 78 aa, synthetic construct
KIRWLHRMIKLFNKLVTRSLLKHTKKRDALRKHHKAWALAPKTCRPRKRKAEWKLLKKAYAAYLDRYTLHLKAGKASW

SEQ ID NO: 1501 - protein, 43 aa, synthetic construct
RMRLLKKWWKRLRKAKERWLKGSKAAAGNHFGLDCGNADHRKY

SEQ ID NO: 1502 - protein, 44 aa, synthetic construct
IYRFFRKLLRWYRPRYIMMLRKRARAVHAAIRRLCLKKELPCLT

SEQ ID NO: 1503 - protein, 60 aa, synthetic construct
KIKLFNKLMKRLTKSQLLMACLLKKRAAMMRPKLQSVAKKLHDFEAQFRNVSKKKHRERY

SEQ ID NO: 1504 - protein, 33 aa, synthetic construct
KMKLLKKFFKMLSRHLVLRDCKLAATLKKKKGG

SEQ ID NO: 1505 - protein, 27 aa, synthetic construct
RWKLLPRWLKRIKKHAHLYGYLTREGA

SEQ ID NO: 1506 - protein, 52 aa, synthetic construct
RIRWFKKFMRMLPKALVTQFRLDKYLAKRAWLKALILLLKLLRKFGIIQTVQ

SEQ ID NO: 1507 - protein, 38 aa, synthetic construct
LLRYYNRIFKRFPTFKDKRMYAARHLLASKGLQRQLAR

SEQ ID NO: 1508 - protein, 29 aa, synthetic construct
FLKYLSRLIRRFNRRTYLLMNNLTLKKLR

SEQ ID NO: 1509 - protein, 41 aa, synthetic construct
RYKILNKLLKIMCQRACALRKKQAEKWLAARDHKQEMAAAY

SEQ ID NO: 1510 - protein, 74 aa, synthetic construct
KFKFWRRIFRKLKPNRAPHAFAKFMAFARKSPDLMNKLDMWLARTYPKALKQRKGHNLKKAAKIAALRLNALFH

SEQ ID NO: 1511 - protein, 32 aa, synthetic construct
WLKLYRKLFRRLTKSACADKAPTALLLRKKAR

SEQ ID NO: 1512 - protein, 28 aa, synthetic construct
YLRILNKWLRFMRNSCAILKARKEAKAV

SEQ ID NO: 1513 - protein, 71 aa, synthetic construct
FYRFLQRLWKKMKRKAARIILLQHPLGQKKCAAFRCFHKKATRQWAMVALRHKRALAYLLCLAAKECIKNK

SEQ ID NO: 1514 - protein, 55 aa, synthetic construct
RFRLFKRFLKRLKKKMCAGPRDALFERECRQYARAGLAFPLDLWRASMGTAARKW

SEQ ID NO: 1515 - protein, 54 aa, synthetic construct
RYKFLKKLWKWLRKLEEKSQMCSWRFAKRNTFLAWKKVAWRKAVKAAVNLLHRL

SEQ ID NO: 1516 - protein, 23 aa, synthetic construct
KFRMLRRFLKRYRNAAFAASKAA

SEQ ID NO: 1517 - protein, 35 aa, synthetic construct
FLKFLTRMLKFYHNRLRARKTDATCCALKLKQCLK

SEQ ID NO: 1518 - protein, 38 aa, synthetic construct
LIKLMNKYMKKLKKKCGDAARSLKAPLWNRRKRLYDAH

SEQ ID NO: 1519 - protein, 43 aa, synthetic construct
KWKLWRKFIKKLRCPKLLADLLTDMKNRTAHRINLCAMAYAKA

SEQ ID NO: 1520 - protein, 20 aa, synthetic construct
IFKYMNKLLRYLKRLSRPAV

SEQ ID NO: 1521 - protein, 58 aa, synthetic construct
RIRWFSKFFRWLRKAKSTKLKHTRKLIRLVLAKRYFRLLYARLYSWKCLVLLTLHKVF

SEQ ID NO: 1522 - protein, 55 aa, synthetic construct
LLKLYPKILKRWKQMAYRQLVAAEFQEDKKMCKFPRRRTREYALAKRKTARAHHL

SEQ ID NO: 1523 - protein, 45 aa, synthetic construct
FFKWFKKIMKLWCRRQKASLRYLRLRCRAYLLLKLARQWRAPLIQ

SEQ ID NO: 1524 - protein, 90 aa, synthetic construct
RLKLIKRLLKIFRTLFKPAWFGRFRKYKDGKERKLAEFLAYALRTTLPRLRKVDNRVHRLLTRIPKAKFLHDKNPRCLLRLSAGAKKRYN

SEQ ID NO: 1525 - protein, 22 aa, synthetic construct
LLRYLRKLMRKWRKWALCHYNY

SEQ ID NO: 1526 - protein, 29 aa, synthetic construct
FFRLLKKLWRKLTPKVAAKLRESIFAYML

SEQ ID NO: 1527 - protein, 20 aa, synthetic construct
IFKFICRLLKRLNKQLELLN

SEQ ID NO: 1528 - protein, 95 aa, synthetic construct
LFRWYRRLLRKLSSHQIAAWKRATFRLTNLLRLTAKRELIADHRKWARFAIKNKNKCKLIAPNVIRCPKKLVRKDGRAQAWRLDTLKTHKKACLN

SEQ ID NO: 1529 - protein, 28 aa, synthetic construct
LWRMLRRIFRRLSKVMMSLKLNAKWALG

SEQ ID NO: 1530 - protein, 34 aa, synthetic construct
WFRLFKKLYKLMRQKRELRVNMLCPNKLAAIRAM

SEQ ID NO: 1531 - protein, 33 aa, synthetic construct
RFKYLKKFLKRLKTLIKLPRYEFLAPWLDYKAK

SEQ ID NO: 1532 - protein, 34 aa, synthetic construct
RIRWIRRYLKFLCKWAKLSLQKLKNMWAKAWEKN

SEQ ID NO: 1533 - protein, 35 aa, synthetic construct
LYRLWNKFIRKFRRLALKEFLDALLMSVIRANKRL

SEQ ID NO: 1534 - protein, 25 aa, synthetic construct
WLRYYRKLLKLFCRKFQKRLACWYA

SEQ ID NO: 1535 - protein, 55 aa, synthetic construct
RLKWLCKLLRRWHKVSRPTLRVDKREYGAEHALRMYACPKRRAACANAARYSARA

SEQ ID NO: 1536 - protein, 56 aa, synthetic construct
FFRLLCKFLRKLCRKKATRAAKDLFDNVKECANRLRPADLYKHWLKGKMAKKAFRT

SEQ ID NO: 1537 - protein, 32 aa, synthetic construct
LLRLIKKFLRKIPQKRRRRMLWRAWALQRITA

SEQ ID NO: 1538 - protein, 43 aa, synthetic construct
IWKLYRRFLKFMRKKMHWLRAANRYFLLIALFLLHLAFTRIRS

SEQ ID NO: 1539 - protein, 23 aa, synthetic construct
RWKFLRKFWKLFTRRPLAAQLLI

SEQ ID NO: 1540 - protein, 85 aa, synthetic construct
ILRLFTKMLRYLPCAALLTVTILRTEIVDARRLRLFKCLFLKRLRERFQKLRAPGELAQAAQAYLLGDKVVKHTGLTLTRRKPKA

SEQ ID NO: 1541 - protein, 27 aa, synthetic construct
KLRLLKKLLKRYCPQMCTAQAHGFAVK

SEQ ID NO: 1542 - protein, 36 aa, synthetic construct
KFKLFRKLFRMWRHAADALKGKLRKQYTVSASDATR

SEQ ID NO: 1543 - protein, 41 aa, synthetic construct
RIRLYCKLYRRLSRCASRCRFIALKRKLRELYFPKDYRAAY

SEQ ID NO: 1544 - protein, 28 aa, synthetic construct
LLRLWQKLWRKLRNHWLRTQYLRAAYDH

SEQ ID NO: 1545 - protein, 22 aa, synthetic construct
IFKLWKRYLRILHQKLPALRPR

SEQ ID NO: 1546 - protein, 27 aa, synthetic construct
MLRYLTRFLRKISKAAAKKMCPGKYAL

SEQ ID NO: 1547 - protein, 34 aa, synthetic construct
RLRFLHRFLKLIRKALRPAYRYTSKRYLIFDGLW

SEQ ID NO: 1548 - protein, 57 aa, synthetic construct
MIKYYRKFFKILRKRVWALINGKKLLATAALVMKATWLAKHSKKVRRKPQIARGLTR

SEQ ID NO: 1549 - protein, 42 aa, synthetic construct
KLRLLRKWLKRIRQRQKLLVKLPARLDRRPQSKLSKRLLHDS

SEQ ID NO: 1550 - protein, 45 aa, synthetic construct
KLKIMNRFLKKWSSAFIKILHKLKLIKTLAKALKAMQLVGLQHFR

SEQ ID NO: 1551 - protein, 21 aa, synthetic construct
RLRLFNRLYKILKPHARRNLK

SEQ ID NO: 1552 - protein, 65 aa, synthetic construct
KMKIFQRLLRWYRSDARLRSIHRANRIPHMLLRAKKARLANRIYMVALAAYWKNHRSQAEKASKL

SEQ ID NO: 1553 - protein, 27 aa, synthetic construct
MMRLMPRLFRRIKQTLQAHKRLSANLK

SEQ ID NO: 1554 - protein, 29 aa, synthetic construct
LYKWWKRLMRLLKNPKTCLTRAARWANSL

SEQ ID NO: 1555 - protein, 32 aa, synthetic construct
RMKFLRKLLKKLCRQYYEIKVALLYAYRAHAH

SEQ ID NO: 1556 - protein, 37 aa, synthetic construct
KLRYLQRFLKRFNHSAFRARPLKLDAMMLWLKIRLFI

SEQ ID NO: 1557 - protein, 34 aa, synthetic construct
YLKLLRKLLKYLRSKLQIYIPQVYRYYARKKALH

SEQ ID NO: 1558 - protein, 61 aa, synthetic construct
KLRWFRRIIRKLKKNRELRYTSAAARRSCNRIAWSVALTLAWETRFWLKMVYKRVKAADKK

SEQ ID NO: 1559 - protein, 25 aa, synthetic construct
LWKLWRKILKKLRHEMRLHKAHATA

SEQ ID NO: 1560 - protein, 38 aa, synthetic construct
KLRWLKKWMKKMRRECTRAIYKPALDSAKLCAKPWHCL

SEQ ID NO: 1561 - protein, 29 aa, synthetic construct
FLRLFCKLYKWYHKLLLALRKTGGIRRKL

SEQ ID NO: 1562 - protein, 37 aa, synthetic construct
RLRLIKKFYRYWSRASLLARWALNLKANYYRKKDVHR

SEQ ID NO: 1563 - protein, 35 aa, synthetic construct
KLRFYRRLLKFFKRMVKPAMSARALKLAMPCLLTQ

SEQ ID NO: 1564 - protein, 63 aa, synthetic construct
WLKLLKRMLRLLPKRRKTRSSALWNTDANVKAGLELGAGHKRMKPVRRLRSLEWARLAKPAKR

SEQ ID NO: 1565 - protein, 58 aa, synthetic construct
RLKWLKRLLRRFHKKKCLKVPHRWLELDRDHLKRALCGREILAVFCSPRWLSLLLFAG

SEQ ID NO: 1566 - protein, 34 aa, synthetic construct
RFRFWKKFLRLFNRKHKDNQAANRLSAGRLANTR

SEQ ID NO: 1567 - protein, 51 aa, synthetic construct
LWRYIKKLLRWLRCLLRVAEALIFARRDHRARLWIRLKCKTKLVSCRMRQG

SEQ ID NO: 1568 - protein, 47 aa, synthetic construct
LLRIYRRLLKKWSRAGRHREGAQLKARNLLRSTMKMRVYATMARHYK

SEQ ID NO: 1569 - protein, 56 aa, synthetic construct
RLRWLTRWYRKWNKMHLELKHHGLLKLAKRLSKLAHLQLLRLQKSELDILRDFPSP

SEQ ID NO: 1570 - protein, 41 aa, synthetic construct
WYRLLTRFMKKLKKKLPVRYAAAKYLRQDKIYAGRVCLIKI

SEQ ID NO: 1571 - protein, 65 aa, synthetic construct
FFRLWRRLLRFLRKHYALAKWKTAEGAKPLAEAYARRALYQQVLMIHKLKESRDRHAFKNMNLAH

SEQ ID NO: 1572 - protein, 64 aa, synthetic construct
LIKFLSRWWKRMKPAMRKFKALQKLLMRKYYTEHAWLRPFKAPSYMKALKFRLKQLLKNKKKWT

SEQ ID NO: 1573 - protein, 41 aa, synthetic construct
RYRFFRRIMKRLHKDIRKGRLAFDAAAAKVCKPAISKKLHA

SEQ ID NO: 1574 - protein, 40 aa, synthetic construct
KLKYMKKWFKLFSRALNHLPISKALRNHRICAVRLVKKTR

SEQ ID NO: 1575 - protein, 65 aa, synthetic construct
RLRLFKRWLKLYRQVALIAAAFRKKKDFAQAHKTKLAMPLKGKARRTVVLHLMEACKRDRYFLAL

SEQ ID NO: 1576 - protein, 29 aa, synthetic construct
RLKYLRKLLRRYKKSLSLLLWSRVREYGA

SEQ ID NO: 1577 - protein, 56 aa, synthetic construct
KLKFFNKIWRLLRPLLLLTKPYLKCLFLRPFKNKASFKGKDAKAHKLRFAVIAKNI

SEQ ID NO: 1578 - protein, 59 aa, synthetic construct
RLKLLKRILKWWKKTMTRKRLAKGIVAPAKLTESWALCLALYQEYRKANFDRWLNRRMP

SEQ ID NO: 1579 - protein, 25 aa, synthetic construct
RFRLLKKLLKRFTHAREFTLQRWHQ

SEQ ID NO: 1580 - protein, 38 aa, synthetic construct
IYRWFCRLWKLIRTILRRQLKRREARAKAAHKATAHHN

SEQ ID NO: 1581 - protein, 31 aa, synthetic construct
WWKMLKKIIKLLKREAANNCKADAACAVRKY

SEQ ID NO: 1582 - protein, 67 aa, synthetic construct
RLRWLKRLYRFFKCTTISKLQKKLRNKLLARTRCRRGKRQAQDLALLPAQWRVLYMWCKRPQCACNA

SEQ ID NO: 1583 - protein, 52 aa, synthetic construct
RWRWFTKLYRRLTKRRAAIFRQRAYNACRTTMAYKYIKYAAKFAALGRLKCM

SEQ ID NO: 1584 - protein, 34 aa, synthetic construct
LLRYLSRFIKYFHKEKSRAELRRRRWKKAALAKA

SEQ ID NO: 1585 - protein, 42 aa, synthetic construct
LMKFLHRYWKLWKKAQEYPYARLQREALERAAAKERILLAMK

SEQ ID NO: 1586 - protein, 27 aa, synthetic construct
LFRMLRRWLKLWQRKAKVKSCAQLSLK

SEQ ID NO: 1587 - protein, 24 aa, synthetic construct
LYKLLKRYWKKMRHARACLDAKRP

SEQ ID NO: 1588 - protein, 20 aa, synthetic construct
KYKLYKRYMKLMNKMAKPAA

SEQ ID NO: 1589 - protein, 25 aa, synthetic construct
FLRLLRRLYKRIKRKHEQAPAFSPL

SEQ ID NO: 1590 - protein, 26 aa, synthetic construct
KLRLFSRLYKFLHKHYNWFRLVAALR

SEQ ID NO: 1591 - protein, 67 aa, synthetic construct
MMRLIKRIWKWLRTVRKCDDALRREDAYLLKALWTNKKTQLAKLCLRKRLLMRWYRLLMEDQKYVAL

SEQ ID NO: 1592 - protein, 100 aa, synthetic construct
KYRFFSRFLKWWQCKGLRKPKNAVLAILKRRQAKDTPEAGPWAKKLRKNHAKLYRKLCRAKRLAPKERLGSLITFKQRCSAWAVPALARIVCRHLRLKYT

SEQ ID NO: 1593 - protein, 34 aa, synthetic construct
IWRYYTRMFKRLSRLLILMLRKFRLRACMTRGAA

SEQ ID NO: 1594 - protein, 23 aa, synthetic construct
WLRLLTKLLRKLRKLKKPMANCT

SEQ ID NO: 1595 - protein, 28 aa, synthetic construct
KIKWMPRLLKLLKPKADKSVGKRDAHAH

SEQ ID NO: 1596 - protein, 27 aa, synthetic construct
KWKLLQRLLKRMKSLCWKKLDPLVKMT

SEQ ID NO: 1597 - protein, 38 aa, synthetic construct
LLRLWRRLMKKLHRRVAFEHAYPAKAYKWLGAQARELT

SEQ ID NO: 1598 - protein, 20 aa, synthetic construct
WLRFFRKFFKMLTSKMAAAA

SEQ ID NO: 1599 - protein, 70 aa, synthetic construct
KFKLLPKLIRLWKRDRDWLASLRTLLALGLKRAWKNIIRMLDGKERGQSLILLCFRLRRKLIKYVAKNKK

SEQ ID NO: 1600 - protein, 41 aa, synthetic construct
LWKMLKKFLRKLNPLWELKKFPALCDLALRKLGWEDYTKRA

SEQ ID NO: 1601 - protein, 39 aa, synthetic construct
KMRLFKRFLRKWSRAWLGKLQASKRAADARYYNKEANWE

SEQ ID NO: 1602 - protein, 33 aa, synthetic construct
WFRMLKRMLKKLPRIAACLRDLCIAKYLNRTLY

SEQ ID NO: 1603 - protein, 41 aa, synthetic construct
RWRLLHKLWKLLKKLIKASLRTRFYKDLPAYCAVAALCLKG

SEQ ID NO: 1604 - protein, 29 aa, synthetic construct
FFRMFKRMWRLLRREANIPAALPLTRRLH

SEQ ID NO: 1605 - protein, 61 aa, synthetic construct
RLRYLKRLMKRYRKLPMARRTVRDAYRLLLTRRSCHPALAMLLAEHYHRPAWYRYKIKLKY

SEQ ID NO: 1606 - protein, 34 aa, synthetic construct
RMKLLTRLLRYLKRLGAVERKLAAQPNLNWWQRI

SEQ ID NO: 1607 - protein, 92 aa, synthetic construct
KFKMLHKLWKKFCKDHFRLRAECQCHEKSKHLLKLRLETKLIKTARMRKLAKAQYAARVVLCTKHYKRSKHTLLRKYLPLARAAKLPKEHKR

SEQ ID NO: 1608 - protein, 33 aa, synthetic construct
LFKFLTKMLRKFHNILRSAIYKRKLDELRAGAL

SEQ ID NO: 1609 - protein, 24 aa, synthetic construct
WLRFLRKLIKLFTKPLQKSQFRLA

SEQ ID NO: 1610 - protein, 63 aa, synthetic construct
KFKFFHKFLKLMKTESLWRAWTLWKMAAEKATRANSLKFKAILRAKKPALDCLLLFGHLFKAE

SEQ ID NO: 1611 - protein, 85 aa, synthetic construct
MWRLLRKFLRKLKPRWNHLNHKVIAKHLAAKFRARKKHVWARLLSAERPHTFKADFDKHRLAKSQQARLQPKREDTWLLTMLERR

SEQ ID NO: 1612 - protein, 30 aa, synthetic construct
MFKLWKKFLRRMKRAKALVAVKWQLADKLK

SEQ ID NO: 1613 - protein, 28 aa, synthetic construct
FLRLFKRLLKRLTCDRAGAHSSGKRFLA

SEQ ID NO: 1614 - protein, 44 aa, synthetic construct
FIKLFHKLWRYIRNNDWLLAKKLLKTRRFRRKAANKAGCDCLGR

SEQ ID NO: 1615 - protein, 37 aa, synthetic construct
RLKLLKRLIKRLKHAALKAHAWRKACRSDYPFLHQWL

SEQ ID NO: 1616 - protein, 66 aa, synthetic construct
KWRLITRLMKKFKCRLCKDLWHKEHHAAELRYPKAKCAKAWALKCKKLKNKEARWKSTLLLGKHLF

SEQ ID NO: 1617 - protein, 66 aa, synthetic construct
RLRLWRRFYRLFNHVAKKKKWFYEALKLLAFRCIGFRCAAKACDKYMTLKAEKKQMWMGKKKAGAK

SEQ ID NO: 1618 - protein, 36 aa, synthetic construct
RLRLWKRWLRLFRHCPPAARWKATAQAGRILDRVAM

SEQ ID NO: 1619 - protein, 42 aa, synthetic construct
RWRLFRRLLRLMHPLRQLSKKMYATLLPGRADKRNKQAFWLL

SEQ ID NO: 1620 - protein, 41 aa, synthetic construct
WMKIIRRWWRFLKRTLLTKSLRALRSAKRHLLAPYLLICSR

SEQ ID NO: 1621 - protein, 38 aa, synthetic construct
FLRLLKKFYRRFKHLYARPTIAIRLLACIRLSWLAKKF

SEQ ID NO: 1622 - protein, 32 aa, synthetic construct
KLRLLHRYFKRYKRLKLGAKLALDLQRGLRKM

SEQ ID NO: 1623 - protein, 36 aa, synthetic construct
WMRLLPRWLRKLRRAGLWRQKAARGYSMCRMALRHR

SEQ ID NO: 1624 - protein, 26 aa, synthetic construct
FMRFLCKLWRLLKTAKKKVLIARAEF

SEQ ID NO: 1625 - protein, 56 aa, synthetic construct
WIKYLRKLLKRIRKCANGQLLCPKSVMMAHRKRYAFWPRGLKYLALAKKQRAIKTI

SEQ ID NO: 1626 - protein, 20 aa, synthetic construct
FFRWLNKWLKLFRRASYRAH

SEQ ID NO: 1627 - protein, 89 aa, synthetic construct
LYRFLCKIFKFWKKNAFPRTRKRMKCTADMYYRKPTMALLKAKRKLMFPKLERRALLQRPNLRPDLLLVIMLLVAKNEEMKKVALKRRC

SEQ ID NO: 1628 - protein, 33 aa, synthetic construct
LLRLFSRLFRKWKKINQFLRTMHRRLLRLHYCL

SEQ ID NO: 1629 - protein, 74 aa, synthetic construct
LFRLWCRMLRRLCRLHISKRAATYLMMGEHAAQQLDDIKSHFSRKRARRPATARWALKARAFLQNKKFSMLKLR

SEQ ID NO: 1630 - protein, 85 aa, synthetic construct
KIRMLRRLFRRFKRDRCPFLKLHAGLARDKRHEDQTWKATFLRKRFVVKLLKGADAAEASMADAKLKVLKEFFAKLSGAGRRWLC

SEQ ID NO: 1631 - protein, 27 aa, synthetic construct
LYKFLKRWIRKFPKSLLIATARARAQL

SEQ ID NO: 1632 - protein, 30 aa, synthetic construct
LWKLWNRLWKKYHQWAKKRAMLAFAKNIRC

SEQ ID NO: 1633 - protein, 31 aa, synthetic construct
YMKMLRKLLKKLKRKAYSLRGTLATKQLKWV

SEQ ID NO: 1634 - protein, 58 aa, synthetic construct
KLKLFTKIFKMLKCMWTKAAKYLRANGIRGNAKARAHGLGGAAHRQKALLIAYENKNA

SEQ ID NO: 1635 - protein, 33 aa, synthetic construct
KFRWMRKFFRRFKRAMYPALLKKHKACSLYAAG

SEQ ID NO: 1636 - protein, 25 aa, synthetic construct
RFRYISRLYRRIQTMRSAALAKLLP

SEQ ID NO: 1637 - protein, 72 aa, synthetic construct
RYRYYRKLWRRYKRLVSRAKGRSRNLGLTAAAGVCLKMSNVAWDAHLFAIPALRWRCARPKAARKDRPSAWL

SEQ ID NO: 1638 - protein, 43 aa, synthetic construct
KLKLLKRLWRFYQKLWAKLCDHVLKGVPKLEYASLQKWVKHAL

SEQ ID NO: 1639 - protein, 23 aa, synthetic construct
KLRYLNRFYKMLRQRAKTLATID

SEQ ID NO: 1640 - protein, 20 aa, synthetic construct
RFKLISKWLKLFTRECARLR

SEQ ID NO: 1641 - protein, 75 aa, synthetic construct
KLRMFKKILKKLQSKNVYKLLAYLPRRWQLSAKKTLKLHRRAMEGFWLARKWRKRANQRADYKWFRLLHWAHWQW

SEQ ID NO: 1642 - protein, 26 aa, synthetic construct
RLKLMPKLFRKLRTATNLAWNGVLNK

SEQ ID NO: 1643 - protein, 49 aa, synthetic construct
LMKLIRRFYKRLKRCHFTWWLTNKLLRNRKMFKNRRHELCARDCAAAAM

SEQ ID NO: 1644 - protein, 81 aa, synthetic construct
KLRMLRKLFRRMKKRRSSKAGMRWKKLYLEHRLMSLVAKVAQANLRPEYLKACHLFLKCHASRNIQMRHGKAGRASRKWNR

SEQ ID NO: 1645 - protein, 36 aa, synthetic construct
WFKLLPKLFKLLKQAHYKLWGLLATHRTKMWDKDKA

SEQ ID NO: 1646 - protein, 41 aa, synthetic construct
KMKYFKRYMKRLRQAYLLFALQSRHLPLARHMLMVKAWLRA

SEQ ID NO: 1647 - protein, 43 aa, synthetic construct
FYKLFNKLLKRIRRWPLSHALIKLAAYKLRCLKAKQTCVAVHR

SEQ ID NO: 1648 - protein, 38 aa, synthetic construct
RWRWIKRLIKLWQKLKQATAWAKPRALNEKCSKNRNHL

SEQ ID NO: 1649 - protein, 43 aa, synthetic construct
KFKLFKKLLRRITKWRFSLWPKLTPLLRAKIRYAPFAGVKFKM

SEQ ID NO: 1650 - protein, 23 aa, synthetic construct
RFRLIHRYLKLFNRACRFAAVIK

SEQ ID NO: 1651 - protein, 65 aa, synthetic construct
FLRWFKRYYRKFKNTEHKLRRIAILDLEKWWFMARRKKKLAAGLKFKSIALHRIRVKLSIRACWA

SEQ ID NO: 1652 - protein, 25 aa, synthetic construct
KLRLLSKLIKKIKHFMMQLACARKF

SEQ ID NO: 1653 - protein, 73 aa, synthetic construct
KYRFLKRFYRKLKKMAVWLKCLRRYFLKWAAKALMLTASKRCQKVKARGANCRRMARHRSQFAAMKDNLTAPK

SEQ ID NO: 1654 - protein, 94 aa, synthetic construct
KLRLLRRWLKRLSHLIKLAYKRRKTKRCVRCCRTLRRHKDRLWRGCRFLQKAQVAAAAAHKKAQGKREYQRCLLPTYALYFLKDRKKKLACKRI

SEQ ID NO: 1655 - protein, 41 aa, synthetic construct
YIRYLRRILRKLTRKASLRKLYKADYTLQFHAASMLLLRFT

SEQ ID NO: 1656 - protein, 32 aa, synthetic construct
RFKLLQKLMKFIKNFFGLPRDKLHTQKLLRKA

SEQ ID NO: 1657 - protein, 25 aa, synthetic construct
KLKYFNKLLKFWCSLLRKRTCRENL

SEQ ID NO: 1658 - protein, 32 aa, synthetic construct
RWRIIRRWFRRMRSRNGELLALLNAALRRPRL

SEQ ID NO: 1659 - protein, 47 aa, synthetic construct
KLKFIRKYYKLLKKIKNQRWFGRKKRMAAMKRYLAAWEAALALKEGN

SEQ ID NO: 1660 - protein, 47 aa, synthetic construct
KFKLYKKLFKWLSHRALRWKDRLKAASAPFFWRNAYYKKTWNTLLLF

SEQ ID NO: 1661 - protein, 45 aa, synthetic construct
RFRFLKKLLKFYRPPALKAQKLNLKADMAPICVLKRLLYWNYACT

SEQ ID NO: 1662 - protein, 28 aa, synthetic construct
LYKWLRRWLKRWTHLRMRILTRRAIPAP

SEQ ID NO: 1663 - protein, 31 aa, synthetic construct
MLKYWHKFMKLWCRKEQAALMLDKRLLKLLM

SEQ ID NO: 1664 - protein, 48 aa, synthetic construct
FLRLIRKLLRLWPSHIAAADRKRLKQGGAIHRRCTKLRKWCIRALVLA

SEQ ID NO: 1665 - protein, 60 aa, synthetic construct
YLRFLKRMYKFLRKLAGLVYGNLLRGLIKQKAVLRWPYHKHDREKAPKGTKRHAAAAYLR

SEQ ID NO: 1666 - protein, 20 aa, synthetic construct
FFKLLRKLWKWFTRAAPKAA

SEQ ID NO: 1667 - protein, 20 aa, synthetic construct
RLKLWKKIFKLIHSARELKY

SEQ ID NO: 1668 - protein, 30 aa, synthetic construct
RYRYYHKLLKFLCKIWRKKHALCKAACKFC

SEQ ID NO: 1669 - protein, 73 aa, synthetic construct
RWRYMRKILRKFKKPKVLKCMRLLQTLVHNYKAKLHARLDTGARAFWKAAEKSAAICPFLLKRNYRKKAKKAK

SEQ ID NO: 1670 - protein, 73 aa, synthetic construct
RLKILSRLIKWLKKAARRKPEAYALWPAKKGWWWDYQRWLAMLALILCADEAWLVRVRTDARSRIFKKKCALW

SEQ ID NO: 1671 - protein, 23 aa, synthetic construct
KYKFLKKLLKILRRYQLRKLLVI

SEQ ID NO: 1672 - protein, 40 aa, synthetic construct
YYKLWRRFIRKYPKLPRRDKAHAERQIKRAWLKTGLATIL

SEQ ID NO: 1673 - protein, 64 aa, synthetic construct
KMKLLKRFLKKMPRPKARADKGGWAESGLKARAMRLLACAYGCMPLLKAKKVRKRYQCRIQLAI

SEQ ID NO: 1674 - protein, 53 aa, synthetic construct
FIRLLRRFFRLWRKKRLATAQGWSKMRVLELNECARLKRRQKCKRKAALLLLK

SEQ ID NO: 1675 - protein, 42 aa, synthetic construct
RLRMIKRLMRKWPKRQARIHGLALAALEDLNFYALNFIHLRR

SEQ ID NO: 1676 - protein, 57 aa, synthetic construct
YFRLWRKLYRKIKKFELKTQRKCHTRAVVAFLRRAAKNIQLAADLRAKLQGFFHAIK

SEQ ID NO: 1677 - protein, 98 aa, synthetic construct
RFKFFHRMLKKMCRRLLRYGRLRKLLAQKVAIRCMLLLVLSYQRAAMDLAWKKDAVKALFEMARPRLKRNSMRLLKPQVKRRLLYAPVMVRIAAKVYY

SEQ ID NO: 1678 - protein, 62 aa, synthetic construct
KLRMWSKFIRIYCRARLFRKRFDLYAKRAARALVCADAFCAILPRVLRMQCRASLKLEAKLA

SEQ ID NO: 1679 - protein, 29 aa, synthetic construct
WLRWIRKLLRKIRKDPYAHTLLKLNLFRA

SEQ ID NO: 1680 - protein, 85 aa, synthetic construct
RFRMLSRLFRRMKRRALIKAERKAALHRMRRLDRAFKRNRVPAKMIDNIKNESGNCPAWPALNLDTARKRKPLYRALAAMSWLLR

SEQ ID NO: 1681 - protein, 29 aa, synthetic construct
ILKYLSKWMKWFTKELLDQNRARKRAKHA

SEQ ID NO: 1682 - protein, 51 aa, synthetic construct
RYRLLKKFMRRYRRKNDAPSYLWHKWQIAALLEARMRMRALCMAPLKRKIN

SEQ ID NO: 1683 - protein, 30 aa, synthetic construct
RYRLWRRIYKFLRRRFWHHWTLLKRHLEAA

SEQ ID NO: 1684 - protein, 26 aa, synthetic construct
LLRFLKKLIKRLRRLMHRCLLTNRLL

SEQ ID NO: 1685 - protein, 28 aa, synthetic construct
MLKFLRKLLKFFSRNALHLKKFKFRRAM

SEQ ID NO: 1686 - protein, 42 aa, synthetic construct
KLKYFQKFIKWLSRLKKARMKLLTCLEFEQLLKAPACHSLRR

SEQ ID NO: 1687 - protein, 57 aa, synthetic construct
RLKWFKKLLKKINHAVTKRKARLWAVAATALALARQRRKIRDPHYACLKHLAARQAL

SEQ ID NO: 1688 - protein, 33 aa, synthetic construct
FLRLFKKFLRKLSRADFTLLQKRIALMRHKCNL

SEQ ID NO: 1689 - protein, 78 aa, synthetic construct
LLRYLKRYMKKMTRAKRKKRLRQKQKQRIMLKYALGDWFILTKTDATLMKARPSIWRWKRSRKNRGDAWHRALNLALA

SEQ ID NO: 1690 - protein, 47 aa, synthetic construct
KIKFWCKFLRKLSKHLKRILALTLLQKNAAEAMKNCQDARNSKGRAH

SEQ ID NO: 1691 - protein, 31 aa, synthetic construct
LIRLLRRLFKLLRPTIAKRPKDRRVKVEASL

SEQ ID NO: 1692 - protein, 61 aa, synthetic construct
LMKLLRRLIKWIKKKHKHILWKKNKAKRRALEARGAGCKSNIAFKYWCRLVHRNAKLLRHA

SEQ ID NO: 1693 - protein, 70 aa, synthetic construct
FLRFICRFFRLLQKRMIHMNLSTYAKHAKGCCRRKLRQYLKLLVQKLCLKYALLRRALDFMLKKKNKLLS

SEQ ID NO: 1694 - protein, 25 aa, synthetic construct
FFKLLHRFLRLLSRTWRSRLKATRS

SEQ ID NO: 1695 - protein, 74 aa, synthetic construct
KLKLLRKFLRFFHKLQKSAIKKKFENRTHFAIKIYRLMPRRGMPRQRIKVAAARREKRAYVCCRADALLDLMKE

SEQ ID NO: 1696 - protein, 46 aa, synthetic construct
KLKWIKRFLKRLRQARGAAPKCWRLFRAFRASLQKCEVAPTMRKEL

SEQ ID NO: 1697 - protein, 20 aa, synthetic construct
RLKLLSKWFRRLRPLKWGAL

SEQ ID NO: 1698 - protein, 52 aa, synthetic construct
IMKWFRKIMRMLKRLLLWPFRGSLLHNRHRGREAFRVALRFLAKLMCLLHLA

SEQ ID NO: 1699 - protein, 24 aa, synthetic construct
KLRILKKFLRWFHRRLAAKEFFAW

SEQ ID NO: 1700 - protein, 48 aa, synthetic construct
RIRFWTKMLKMYRKYRLRAYRSLWARFYLRFRAKNIAAAWLMRGQRKL

SEQ ID NO: 1701 - protein, 81 aa, synthetic construct
KLKWYRRLFRRLHQRKKFKCRLKLAFAQAAKLFLCAGGTRRYSLALMNKLNRKRDVRMPWRLVDGIAWSPLAHWRINKKAR

SEQ ID NO: 1702 - protein, 27 aa, synthetic construct
YYKLWCKLIRRLSKKMWFEALLIARFK

SEQ ID NO: 1703 - protein, 95 aa, synthetic construct
LIRMFKKFMRMYKNRNTRAMKLLLKKSIELGAFRGLYLLYPDALAGDLAWMVMLVYHARRRASRATRWKGAPTLAKACRKAIIPLALAACKLKRG

SEQ ID NO: 1704 - protein, 49 aa, synthetic construct
LFRIYNKFFRKLKTAEARLLKAKLLRLIAVSKARLKRQWNLAAITELRK

SEQ ID NO: 1705 - protein, 46 aa, synthetic construct
KLRMIKKIYRRLSKLNKLSRQRARIYLAHANRHNYLILNDARTIRR

SEQ ID NO: 1706 - protein, 29 aa, synthetic construct
RLKLFRKLMRLFKRIRMIDMKNGLPSLYL

SEQ ID NO: 1707 - protein, 25 aa, synthetic construct
MLKFMRKFLRLMRRANLQYANKDAW

SEQ ID NO: 1708 - protein, 76 aa, synthetic construct
YLRFFRKIYRRIRKLAPLSMALTERLDPFLLWFFRRQKRDKLCKTKIKPAHRIKRRAFRLTALSVLKKQAFDKLLM

SEQ ID NO: 1709 - protein, 27 aa, synthetic construct
RLKLMKKFMKLWKTQRKGAGTTVAAAI

SEQ ID NO: 1710 - protein, 24 aa, synthetic construct
WMRLLRKYLKRLRKKHADDTFWAL

SEQ ID NO: 1711 - protein, 73 aa, synthetic construct
KMKMLRKFYRLIKKKASHPSDASGKILASRYDLCAIRMDTKLWLKAQRKKYERNKSRPKAKACRRLALQLADQ

SEQ ID NO: 1712 - protein, 41 aa, synthetic construct
LFRLMRKWLRKFRRHATDAKIKRYTCKALMHRASKANATMG

SEQ ID NO: 1713 - protein, 58 aa, synthetic construct
RWRFLPRLLRRLKREVGKRLHPLYKARTLFKSMGDRRMAGLLARDAYRLNIMKWYGKI

SEQ ID NO: 1714 - protein, 46 aa, synthetic construct
RFRFYKRFWKLLHCLYFKNHMAKANLLAAECAAVAHKRRRDRLAWK

SEQ ID NO: 1715 - protein, 38 aa, synthetic construct
KIRIIPRILKLYRNRQPKRKLLAAEAKAHPIKAFYAEL

SEQ ID NO: 1716 - protein, 24 aa, synthetic construct
RFRFFKKYLKYLKHLTRLKAMAMP

SEQ ID NO: 1717 - protein, 27 aa, synthetic construct
KLKWLKKIFKFLQRKAACLHKRFLTLK

SEQ ID NO: 1718 - protein, 39 aa, synthetic construct
RWKIFRRMLRMLKRLDIAAKSSLQYACPARAKERTQHAK

SEQ ID NO: 1719 - protein, 34 aa, synthetic construct
YLKILHRFLKKLSKAKRRMRKMLALFKDLKLDLE

SEQ ID NO: 1720 - protein, 24 aa, synthetic construct
KLKYLRKILKRIHSKLAVLIFQTK

SEQ ID NO: 1721 - protein, 70 aa, synthetic construct
RFKLLQRWWRKYPKRACSYWKVLLKLKRFANYLLMLKPKLAIIRLLCAKLNYDRPRKDRNFKVRGFAKEV

SEQ ID NO: 1722 - protein, 33 aa, synthetic construct
RWKMFRKFLRRWRKLKAARLRAFLCLKHAASPK

SEQ ID NO: 1723 - protein, 40 aa, synthetic construct
KFKLLRRLYKLFHKMVRPRIEHKADAHLNARAACSAEKKK

SEQ ID NO: 1724 - protein, 29 aa, synthetic construct
WLRLYRRLLKKWQQKDKLAPTCLKCELGK

SEQ ID NO: 1725 - protein, 78 aa, synthetic construct
KLRLFHKMIRRYKRLAFHALIIKEIGGTKLAGNKPARAKLKRLWTASKAQATLLLCEKLQLNLVCNKKRGCFFLLRKL

SEQ ID NO: 1726 - protein, 63 aa, synthetic construct
RIRLFQRLLKLLRPKYYCKWPECRALIELDFRKRDPRRRALRAKRHRNEARAASLADRVMRKG

SEQ ID NO: 1727 - protein, 21 aa, synthetic construct
ILRYLKKFFRKLRRYLLEVAG

SEQ ID NO: 1728 - protein, 48 aa, synthetic construct
IWKYMKRYFRRINRYANALGLLIAYKLLRARAEFAYMKAKTLKYKRWD

SEQ ID NO: 1729 - protein, 56 aa, synthetic construct
RIKLFTRMFKLIKKKWMKTLVHMRLVTRRKLMQCWALCLKQKRRIKPATAEALCAK

SEQ ID NO: 1730 - protein, 29 aa, synthetic construct
LLKLLRKILRFFPRAQGDLWGERYRCHRL

SEQ ID NO: 1731 - protein, 37 aa, synthetic construct
MYRMLRRLMRKFKPDYFNSMIKLQPLARLRLRARKLI

SEQ ID NO: 1732 - protein, 60 aa, synthetic construct
FFRIYKKWLRRLQKLLLAKAANIKMERARKMNELTRPFLKRPLKMCLRADIQRKVQPPQL

SEQ ID NO: 1733 - protein, 37 aa, synthetic construct
RLRLFHKFLKKYKRRDKCAQLFLRVHLGFAPVKRPAM

SEQ ID NO: 1734 - protein, 37 aa, synthetic construct
WMRLLRKLIKYYPRAIHSPIAQKGAKAAKLLSFKARI

SEQ ID NO: 1735 - protein, 21 aa, synthetic construct
KYRLITRYFRLYRKKALTLEA

SEQ ID NO: 1736 - protein, 48 aa, synthetic construct
RLRLFRRLFRKLQRLLYLDHRKSAQLTVASDAMICRRSKGNSRIPRAR

SEQ ID NO: 1737 - protein, 27 aa, synthetic construct
RLKFYRRFIRRLQTLKAVANAKREGEA

SEQ ID NO: 1738 - protein, 76 aa, synthetic construct
FLKIMCKLLRLYKRGLLNLAYCHFRSRWRWHGCKARTRRACWRKISSLLRLAWVALHTAEREILWRKACLTRDRRA

SEQ ID NO: 1739 - protein, 30 aa, synthetic construct
FLKLWKRFYRRWSKKRLPAGADASARRHML

SEQ ID NO: 1740 - protein, 36 aa, synthetic construct
RIRLIRRWWRKLRRHRALTTPLAICWLKLSAFYSAK

SEQ ID NO: 1741 - protein, 70 aa, synthetic construct
KFRLLCRLYKFLKPARIKRCLNSPAGAIRKARPPLINKTRLLKWSCRLRKDLAHYAAAKKASNAELVKKN

SEQ ID NO: 1742 - protein, 37 aa, synthetic construct
RLKWMKKLFRKFKKNGLEHSRVKSVLAAWKCNADALA

SEQ ID NO: 1743 - protein, 22 aa, synthetic construct
KFRMLRKLMRFYRSRAKAALEL

SEQ ID NO: 1744 - protein, 64 aa, synthetic construct
KFKLLRKLLKKYKTFAHVAAKGEGWRKLAAKHVRRARSDFSRRKAAIKFAEKQLLKAIKILKSD

SEQ ID NO: 1745 - protein, 43 aa, synthetic construct
LMKILTKFMRRFRRRRKRYKIHAFARYADAAARCQRLPLMACR

SEQ ID NO: 1746 - protein, 57 aa, synthetic construct
RLRFLRRFLKRLKRCLTIPLSAAADKKKRLLRRDKLDFHVANRLLYCIPKCRVAHAG

SEQ ID NO: 1747 - protein, 21 aa, synthetic construct
LLKWLRRFMKKYKRALKAATK

SEQ ID NO: 1748 - protein, 52 aa, synthetic construct
WLKLLTRWIKLLRPKICRDDHKTPLKSRLNAKWLAAEKRRAQAPKMREARFA

SEQ ID NO: 1749 - protein, 33 aa, synthetic construct
RLRFLKRLLKRIHTILLLFQLNIKIGRLTASAR

SEQ ID NO: 1750 - protein, 80 aa, synthetic construct
KFKFLRRYFKRYKHLKRLGYLRAKLRLTKLASYCCFYATFWKCRMAPKARRAGHTRKMWLRDSKFRILRQKAMWLASFLY

SEQ ID NO: 1751 - protein, 22 aa, synthetic construct
FLRYYSKLYKKITKAKARALAP

SEQ ID NO: 1752 - protein, 28 aa, synthetic construct
KMKLYKKWWRKLRHEALLQACQKNAPPL

SEQ ID NO: 1753 - protein, 48 aa, synthetic construct
LLRWLKRYIKKLSRTAEKHMRAKLPAKWTELGLREAYLLICANLNRWL

SEQ ID NO: 1754 - protein, 46 aa, synthetic construct
WLKMLHKFLKKLRKYWRKKLACKTSKLAKRQKSGEMMYGLRAMFEL

SEQ ID NO: 1755 - protein, 20 aa, synthetic construct
LLRLMKKMFRRICCLLKHAL

SEQ ID NO: 1756 - protein, 26 aa, synthetic construct
MLKMLKRWYRRLKTYAEKGTALTAAP

SEQ ID NO: 1757 - protein, 44 aa, synthetic construct
FMKLLRRYFKLLQNLQALSSKADMWARGRKRIILASFKKAARNS

SEQ ID NO: 1758 - protein, 21 aa, synthetic construct
KYKFFCRWFKLWRRAPRALLN

SEQ ID NO: 1759 - protein, 20 aa, synthetic construct
KLRYYRRLMKLLPKFAHLYT

SEQ ID NO: 1760 - protein, 90 aa, synthetic construct
KFKLIRKLWKRLKRCGRQRPRIYLQPDPLKRILAILACLSTNMALLDLNAGHKLKKSMGKAAKRQNRALLKLVLNECLAEELLLRATCVQ

SEQ ID NO: 1761 - protein, 27 aa, synthetic construct
LYKMLTKLFRFLSPKLEKRARLMGFKP

SEQ ID NO: 1762 - protein, 50 aa, synthetic construct
KIRMMTKFLRFWQSPSFKPCLVLLARYLAKRALQLKDRGLKLRRLKKLRC

SEQ ID NO: 1763 - protein, 20 aa, synthetic construct
RIKWFKRLIKLLPKYCDKAL

SEQ ID NO: 1764 - protein, 21 aa, synthetic construct
ILRLFNKLLRYFPPLKGWKKR

SEQ ID NO: 1765 - protein, 27 aa, synthetic construct
LMRFFKRYIKKLRKARKAAGAYLRSFA

SEQ ID NO: 1766 - protein, 33 aa, synthetic construct
RLKLLCKLFKKLRKGEGPKAQLLAKLLLKDCLN

SEQ ID NO: 1767 - protein, 23 aa, synthetic construct
RLRFLKRMLKFLKSIHTILTLYR

SEQ ID NO: 1768 - protein, 69 aa, synthetic construct
LLKFIRRFIKRLQKQQGMRQGCLLTKKAYSMKLPFHTSARARLLAPLLKDASKARCVDAPLKKRVLIKR

SEQ ID NO: 1769 - protein, 30 aa, synthetic construct
RLRMLKKLMKKLPPMQLPALKKRSLKQNLL

SEQ ID NO: 1770 - protein, 63 aa, synthetic construct
KWRWFKKLYKFFHPPQTRHKAGKKMARAWKPRKKLLLKLLKSHPARMMLSLRLLGGLKIKAPI

SEQ ID NO: 1771 - protein, 37 aa, synthetic construct
RLKYMRRFLRFLKKLRALMQAPNMLKGDYARTWPLRY

SEQ ID NO: 1772 - protein, 28 aa, synthetic construct
RYRFFKRLLRFYSTLLKRMAAFAQFSLA

SEQ ID NO: 1773 - protein, 36 aa, synthetic construct
RMKILKRLMKLIRRWAMMLHYALAPRVKRHTNLDNR

SEQ ID NO: 1774 - protein, 41 aa, synthetic construct
FLKLIRKFFRKLRRSALAAFLARKAKDTHTVQMMECRREAD

SEQ ID NO: 1775 - protein, 76 aa, synthetic construct
KIKMYKKMLRIFKRALFCLTMIIRCLLRKDAHIAPYMAQLRRARWAYKDLLFPLRGRRTLSATDLKRKKRYAHRPA

SEQ ID NO: 1776 - protein, 33 aa, synthetic construct
LYKFWKKFLRKWKRALSVLRQLARLPTKLRKSD

SEQ ID NO: 1777 - protein, 22 aa, synthetic construct
KLKLMHKLFRWWKKEIKLPAAE

SEQ ID NO: 1778 - protein, 74 aa, synthetic construct
KFKFMQKMFKRLNPANNLLIYKAIGLKVRLHKRALKNIKWKLVMYCDCKTRCRALCVKRRAGVRAAARASTKLR

SEQ ID NO: 1779 - protein, 25 aa, synthetic construct
RLKMFKRMYRKFRNALKLLMDYRAL

SEQ ID NO: 1780 - protein, 41 aa, synthetic construct
LLRWIRRWLRLWQKGLLKLASKVHKCKQRYGAKCFFMKAQA

SEQ ID NO: 1781 - protein, 46 aa, synthetic construct
KWRYWKKLLRFLRSWHVLKWKHALVRKNQLYDWAYQRARQRNAAAA

SEQ ID NO: 1782 - protein, 21 aa, synthetic construct
RLKWLCRLLKRFSPVYLLTKT

SEQ ID NO: 1783 - protein, 34 aa, synthetic construct
KFKLLQKFLRKLCKAQVKAPACNLQKLRIAMTWL

SEQ ID NO: 1784 - protein, 38 aa, synthetic construct
IWRLLRKFLKLMSRASTKYLPLLAMKVKLGHLLTHMKC

SEQ ID NO: 1785 - protein, 45 aa, synthetic construct
LFKWWKKLLKYLTQRAAFQKRRMACLQSPTRARLRALVTRKCGAV

SEQ ID NO: 1786 - protein, 43 aa, synthetic construct
KLKYLKRYYRKLCKLAWLCGRGLMLTRAAGQKSNMLRCRMAAK

SEQ ID NO: 1787 - protein, 50 aa, synthetic construct
LWKFFCRFIRLYRRKRNWKARLKAKQMKLALTAQLQKEHRLQLWKYMKLH

SEQ ID NO: 1788 - protein, 23 aa, synthetic construct
LFKLLRRMLKKFQKLAPFVKMCE

SEQ ID NO: 1789 - protein, 65 aa, synthetic construct
ILRLLRRIYKRMCKMMKAAKRAKASRAKCTASKEQLSNRARLTAIWLDVHYARNSLRKSDKRLKK

SEQ ID NO: 1790 - protein, 58 aa, synthetic construct
WLKLLKRYFRKFRKCQWLLGKWNASCNQKKLHLPGMTARLEALARSLLKRDDGILGKL

SEQ ID NO: 1791 - protein, 28 aa, synthetic construct
RMRFLKKLLRRLRTGNIKLVHAVYLAWH

SEQ ID NO: 1792 - protein, 26 aa, synthetic construct
KMKMWNRMWRKLKTLAAIRLKGAARW

SEQ ID NO: 1793 - protein, 27 aa, synthetic construct
LYRMLRKLYRRLKNMLRKDLLPVLKEH

SEQ ID NO: 1794 - protein, 49 aa, synthetic construct
LYRMLKKIIKIFKSNAALIWLKAFLVRRAAHLHSMKSLRKFTLRKRKLF

SEQ ID NO: 1795 - protein, 41 aa, synthetic construct
KIKLLRRLFKYYCKRPPLAVRCKVPYRAALAFLRCLLKERR

SEQ ID NO: 1796 - protein, 22 aa, synthetic construct
RWKLWPKMLRRLTKLAASCACR

SEQ ID NO: 1797 - protein, 36 aa, synthetic construct
RFRYWKKMLRRLTKLHWRRLKLMLLCWFRERLIYLC

SEQ ID NO: 1798 - protein, 38 aa, synthetic construct
FLKYLKKFYRRLRQLRQRAWPLHADTCAAHLLRARNPY

SEQ ID NO: 1799 - protein, 61 aa, synthetic construct
KIRMLRRLWRLLRKALKLNFAKYDNQLHRARVKWKLRFQEVLLARRVTKHWGGWRMMHLLM

SEQ ID NO: 1800 - protein, 74 aa, synthetic construct
LIKIIKRWIRLLNNRIKAAFDWAVDHHFLTKMNLAPDRKAHSRRYELDLLAARRRKRIALACLKHWKAQKDPKR

SEQ ID NO: 1801 - protein, 91 aa, synthetic construct
RLRFLKKLIKKFRCAHKWEQLNKLKLCPPKAAGNDNRWLTCRKRRRRDESALYRTYWLMAAVMKMARRAWELALPGLTRMVRLKWAITAAL

SEQ ID NO: 1802 - protein, 28 aa, synthetic construct
KLRFLSKMFRRWKRMTKYHMRLANLAML

SEQ ID NO: 1803 - protein, 20 aa, synthetic construct
RMRLLNRLMRLWSKMPAKLV

SEQ ID NO: 1804 - protein, 72 aa, synthetic construct
YFRIYKKFLKKMRCAALMMRLKSRRKKPLKALAELELKKNHFALLAATVVCKAKWSSFQAFMLWDYELKKTR

SEQ ID NO: 1805 - protein, 80 aa, synthetic construct
FLRFMCRMYRLLQQALRRLDKKRKLPRFKPEPKMAQALWSALRRLAASDMKAHFQLEFCRCLYSKMRILKQGACRGKRAR

SEQ ID NO: 1806 - protein, 58 aa, synthetic construct
KWRFYKKFMRYFTKEYALHYRGATLPKLARKTLARKPPLASKRLQADCMSRRLALVFL

SEQ ID NO: 1807 - protein, 42 aa, synthetic construct
KFRWLNKLYRKWSKPAALLACHERKEWLAASADRLKRRRDLK

SEQ ID NO: 1808 - protein, 88 aa, synthetic construct
RFRFLHKLFRIYSRQARLAAMADYRAVVARRHKPAAARHLRALLLIATKWLTALWKQRALTGNEQRWFFAKFRWCGKNYAKVGAKKKM

SEQ ID NO: 1809 - protein, 59 aa, synthetic construct
WYKFLRRMWKLLNNNVWPGLLCKARARAAKFWRLHIGAKAAKMIMKALCRKPLWRREAV

SEQ ID NO: 1810 - protein, 23 aa, synthetic construct
LLRYLSRFLRLLHRVKAIFDWKY

SEQ ID NO: 1811 - protein, 29 aa, synthetic construct
RIKLWHRLFRMISHRLKKAARAILTEGPA

SEQ ID NO: 1812 - protein, 40 aa, synthetic construct
KFRFIKRYFKKLPKLSWHWAHRARKIRALLGFFLQCAKTK

SEQ ID NO: 1813 - protein, 70 aa, synthetic construct
KFRIWQKLLKLYRRKLYKYYFFHRRRKKNAPFAHKSAAAPKVAYRALARGKLALWAPLYAACKLAILLEP

SEQ ID NO: 1814 - protein, 69 aa, synthetic construct
LLKYLRKLWRKLSKYLHHDGRRCLYHKKWVFARSARPLRLNARRIDDEAFCWMLYLLIKLPCQKRLLRL

SEQ ID NO: 1815 - protein, 56 aa, synthetic construct
KFRIYTKFIRRLRKFLKFYAWESECATAALRRVKSRCDAREYRLTKLKFKAWLARF

SEQ ID NO: 1816 - protein, 20 aa, synthetic construct
KWKMYKKILKMLKSLFHQLL

SEQ ID NO: 1817 - protein, 44 aa, synthetic construct
RMRYIRKLWKLLCRRRNLSWHKKHRGYALHAAPYAVARHVLADL

SEQ ID NO: 1818 - protein, 33 aa, synthetic construct
KMKLWRKLMRKIRSSRPKLLFYQLKEQQRAALE

SEQ ID NO: 1819 - protein, 43 aa, synthetic construct
KWKMLKRLLRFIKCYDKRLWKQATCLDAWKSWLRALKRLAKWL

SEQ ID NO: 1820 - protein, 92 aa, synthetic construct
YFKLMRRLIRYMHRAVAKRISRLLHALQNRIKAKIKQKWLNAKNAALKLMWRHRIKLTKRFRKMATLYMWWLGLLLLISNRANEKNELMAKH

SEQ ID NO: 1821 - protein, 85 aa, synthetic construct
KFRILRKYLKLLSTPAVHEAFKFQKKRAQLASKRRASRKHDGRKLLLRRELWNNQSRTDWHRWLRTKFPFALRRLKNCYAGRMLL

SEQ ID NO: 1822 - protein, 84 aa, synthetic construct
KWKLLKRYMRYYNRLATWNRDRKLIAKMPEMTGAAAVRIFHLLLARYAAALTKKPLAPRIFLAAVKAKKKTTARTAETRKMPRT

SEQ ID NO: 1823 - protein, 65 aa, synthetic construct
LLKMWTRLYRKFKKYRIMKLQDILCLVLDWHWKRRNALYDWHRLFKAEKRKQKAAALMRRCLQPL

SEQ ID NO: 1824 - protein, 27 aa, synthetic construct
KYRLFHRLWKRMPTLVRDAYGLARTAK

SEQ ID NO: 1825 - protein, 43 aa, synthetic construct
KFRLLPRFYRIMKQLKLAAKRKLYQFRAMARYARELTERAWHT

SEQ ID NO: 1826 - protein, 77 aa, synthetic construct
RYRLLCKMLKRLCRLMRYLIRRKIVRMEKKRGDPLKRARAVAPAGGAAALLYIHMMQARICVLKRITKLRTYHAQMA

SEQ ID NO: 1827 - protein, 38 aa, synthetic construct
KFKFFKKLFKLINPLCSKCKAHARLAKRMAVLDILVKL

SEQ ID NO: 1828 - protein, 31 aa, synthetic construct
RLKLLKRILRLWQRTWKFRLRIHSACLYAFD

SEQ ID NO: 1829 - protein, 47 aa, synthetic construct
KLRFYQRWIRKMKRLERLHYRPSDVLRLRAIARIAERLIWAYKLAVA

SEQ ID NO: 1830 - protein, 25 aa, synthetic construct
FLKILKRLFKKFPKKAYYFKAWPTA

SEQ ID NO: 1831 - protein, 33 aa, synthetic construct
LLKYFKKLFKRLRQRAAAKKTKLGGTIHSLYWG

SEQ ID NO: 1832 - protein, 36 aa, synthetic construct
KMRIIQRFFRYLKRQILIALRRGLLFHAKKAANCAA

SEQ ID NO: 1833 - protein, 72 aa, synthetic construct
RFRYFCKLMRLMRKLGANRALKAAARLAYCGRKHAAATIEKHAADRYWLAEGQLLLYYRFMFCFKFDDKKKK

SEQ ID NO: 1834 - protein, 27 aa, synthetic construct
LLRFWRKLIRMFRHRCKSAEASRAGAY

SEQ ID NO: 1835 - protein, 33 aa, synthetic construct
KLRMWRRLFRYLKRKPPAVLMAGADALKANEYF

SEQ ID NO: 1836 - protein, 20 aa, synthetic construct
WFKWLPKLIKFLKHKARLKF

SEQ ID NO: 1837 - protein, 38 aa, synthetic construct
LLRLYHKIIRMFSKHLRYGTIWFRRKEAKWLRALYKLA

SEQ ID NO: 1838 - protein, 55 aa, synthetic construct
KWKIICRLLKKMTPCRCRKARQIAALRLRYDVLRALAEQCGALRARRLKCRLIHL

SEQ ID NO: 1839 - protein, 31 aa, synthetic construct
LFRLYKRLIKRLTQARACMAKARIMALRHKG

SEQ ID NO: 1840 - protein, 57 aa, synthetic construct
WLRFINKFMRKYKNRLLFALYCAETAHGLRDAVRLKANDKRTSWLRKHKKLALSEKK

SEQ ID NO: 1841 - protein, 38 aa, synthetic construct
RLKLLRKLYKRFTRKQQKRRIALHYLQAHEFELRNRAG

SEQ ID NO: 1842 - protein, 35 aa, synthetic construct
FLRLLKKWMRWLRPGALNNARKKYSPSIRLAKRLK

SEQ ID NO: 1843 - protein, 34 aa, synthetic construct
KFRIFKRMFKRLKCELHAWKAKALALRANMLKWL

SEQ ID NO: 1844 - protein, 22 aa, synthetic construct
LLKFFTKLWRLLKKVCPRRAPF

SEQ ID NO: 1845 - protein, 87 aa, synthetic construct
WLRLFKKWMRRMKRAACREQKWMAAKDPANVALALGEKAYHELTETASYRRTDSNLRKKKEPFYRKAIAAWRRKTPSKKRLKLARAL

SEQ ID NO: 1846 - protein, 64 aa, synthetic construct
KLKYMTKLFKKFHTVKKREGKAMNYFLRNLQAAPHRHAVVKRKRRALAAWKLDKAPAKVIHARL

SEQ ID NO: 1847 - protein, 20 aa, synthetic construct
YLRLYTRLFRRMKHRLACLV

SEQ ID NO: 1848 - protein, 45 aa, synthetic construct
FYKYYRKIFKLLKKRTWIKWRLNHARLLIKLKRLMFQAAQRPEAK

SEQ ID NO: 1849 - protein, 54 aa, synthetic construct
RLKLFRRWLKKWRQRALRAMACKTLRTYLLHAAAGQAPTDGAMRMARELTRRRV

SEQ ID NO: 1850 - protein, 52 aa, synthetic construct
KWKFLHKYLKRLKCQLLRTINHANMKLAKTKKPKAGATLRKECRKIERYYLL

SEQ ID NO: 1851 - protein, 40 aa, synthetic construct
KWRFLPRLYRRYRNIKKSARARKRLASLWQAQIPERDILW

SEQ ID NO: 1852 - protein, 53 aa, synthetic construct
WIKIWKRIFKILRKLRKCEALLMDKQKLIALAKKARAYLELKGKLTKRVNAAM

SEQ ID NO: 1853 - protein, 60 aa, synthetic construct
FLRYLRKLLRRLQKLKTKALACGCKGAAWAFEGRKLRKARRLARDNAAFDKWYLLSTWKT

SEQ ID NO: 1854 - protein, 77 aa, synthetic construct
ILRMWKKMWRRWKRLRLGKIDVRAKHLRFEPREELARQTALKRHALRLHRGKSRAMAHLQVGRWIVLALSCGLGLKR

SEQ ID NO: 1855 - protein, 32 aa, synthetic construct
RLKLLRRLYRYWRRYTPALLHRYCQLRSEIKA

SEQ ID NO: 1856 - protein, 31 aa, synthetic construct
FMKILRRLLKMYKRLALRRANMRAWLAQNFG

SEQ ID NO: 1857 - protein, 37 aa, synthetic construct
RFKWICRWFKRLKCHQAKDLRKLTSFARARWKAYALY

SEQ ID NO: 1858 - protein, 39 aa, synthetic construct
IMKLFTKFLRRLRRVPQRMALFLLQLRRRVQRDYASQLR

SEQ ID NO: 1859 - protein, 98 aa, synthetic construct
RLKLIPKLYKKLQTKKKRNAEGNRQEICTQARLVQMALLADLMAKDAIHKLYYAKHWAAKATLRLAARPLIQKALWKTKAQTERLVARMIFKELLLIT

SEQ ID NO: 1860 - protein, 42 aa, synthetic construct
RFKFYRRFFKRMRKGARKAAAFLAWEARAPTCLMALCLRGRT

SEQ ID NO: 1861 - protein, 30 aa, synthetic construct
RYKLWTKLLKMFCHRYLKALLKAGRADKVA

SEQ ID NO: 1862 - protein, 52 aa, synthetic construct
KLKLLRKMWRKFRRCQLKKLQQRCRAFCRLLTLNVVKKYWITYQLAYAEAKA

SEQ ID NO: 1863 - protein, 47 aa, synthetic construct
LLRWFRRLFRKLKKITHAMGMAPQRTLFLNLRKLCAGLWWKDKKSRV

SEQ ID NO: 1864 - protein, 56 aa, synthetic construct
KIRIYKKFFRRLRRLALLLKSCKIKYGAADASASTMLAKTVKRKLKLIKWHLASKS

SEQ ID NO: 1865 - protein, 63 aa, synthetic construct
RFKFIKKILRRLKTMLDKLLAVKHQNHRLKAKTQVWHRQLKQLRKILCARKWGLMKGLCCKAR

SEQ ID NO: 1866 - protein, 78 aa, synthetic construct
RFRLFKKIWKKFKKKKRVLDYTRAARKASELNEKQSLAALGRWWIKDFLLPNKKCLPNQSAHKLRAPKGRRLAALKCR

SEQ ID NO: 1867 - protein, 36 aa, synthetic construct
KIKLLRRFMRLLQKKNAIGALISKFAYAKNGARRRK

SEQ ID NO: 1868 - protein, 28 aa, synthetic construct
RLKLLRKIWKIYRRPCAAGASCAQLNSK

SEQ ID NO: 1869 - protein, 30 aa, synthetic construct
KLRWLSKFMRKWTSMRFKLFLLDKALKKCA

SEQ ID NO: 1870 - protein, 21 aa, synthetic construct
LLRFIRRLFRKWKRELALKHT

SEQ ID NO: 1871 - protein, 27 aa, synthetic construct
RLKMLNRFLRKITKAQAKLMAFLDLRR

SEQ ID NO: 1872 - protein, 47 aa, synthetic construct
RFRLIHRLWKLWKRLIALLQKRLLNKMRAKRIEYLFRHMMKFPLCAR

SEQ ID NO: 1873 - protein, 23 aa, synthetic construct
LLKILKRLLKKLNSGWKCGLRAY

SEQ ID NO: 1874 - protein, 33 aa, synthetic construct
RMRLLKRFLKWYQKLQTRLLKVLRLWAFCIWCK

SEQ ID NO: 1875 - protein, 58 aa, synthetic construct
KLKLWSKFMRYLKCAFCRAQKLLIAKAALAKMAWTFNRQEAARRRHQFQKEVYAARLR

SEQ ID NO: 1876 - protein, 33 aa, synthetic construct
KYRMLSRILRRFQKAKVSCHRWLAKPTKLAVLA

SEQ ID NO: 1877 - protein, 24 aa, synthetic construct
WYKLLCKWLKKMHHLKFRKKQLLA

SEQ ID NO: 1878 - protein, 45 aa, synthetic construct
YLKFWKKILKKFTKVVRILIGLSANRAAAKKANLSAKRTEIKAFR

SEQ ID NO: 1879 - protein, 27 aa, synthetic construct
WLKFLKKLIKWLSKLRAYAHARNEREW

SEQ ID NO: 1880 - protein, 57 aa, synthetic construct
WLRLFHRFIRKLRRMACGKVQVKAFKRYWLLLPKLDRHAHRKRALTAVYKRAAVLWQ

SEQ ID NO: 1881 - protein, 29 aa, synthetic construct
LIKLLRKWYRRIRKVNQYVLCAAHRWAKP

SEQ ID NO: 1882 - protein, 36 aa, synthetic construct
YWKYLKKIYRILRSARYALLAKNPTRKLNALIKKLR

SEQ ID NO: 1883 - protein, 81 aa, synthetic construct
FLKLLKKYFKKFRKLDAKRMKRGLNYKCQRMDPSSLKEVKLKIKLLYDLKWPPSRRAPQIACRTARDRLNDAQKLMALRYA

SEQ ID NO: 1884 - protein, 81 aa, synthetic construct
LLKIFKRYLRLMPHKVRACKRAELARRCKLTYRFTKLEGLGLSEPEKRYAARTWKKIWGAKRTARKMDLLRIKNGRAQRNY

SEQ ID NO: 1885 - protein, 43 aa, synthetic construct
KFKYMKKFIKRIRNCLHAKYRKKLASMRMSAALLARHYCNLAG

SEQ ID NO: 1886 - protein, 21 aa, synthetic construct
KLKMFNRMLKKLRRSLHFDAL

SEQ ID NO: 1887 - protein, 34 aa, synthetic construct
RLRWYRKYLRMLKRMKVWWRLGAFLCKDAKLLAT

SEQ ID NO: 1888 - protein, 26 aa, synthetic construct
RLRYFQKLMKLLKKNASILDAEPRTA

SEQ ID NO: 1889 - protein, 27 aa, synthetic construct
KLKFLHKYMKRFTKEVAPRALKLCLLM

SEQ ID NO: 1890 - protein, 21 aa, synthetic construct
LMRLLRKFLKRLKRGWWDAAR

SEQ ID NO: 1891 - protein, 23 aa, synthetic construct
LIRLITRLLRKLKRHVVRRQAAY

SEQ ID NO: 1892 - protein, 75 aa, synthetic construct
KLKYWKKWYKLYCSKRRVRLTWKRMLKLGRKHRPDLLAVHFAQSRLAKMLYLAREAAKWAPSCNSDHKRLVAKAG

SEQ ID NO: 1893 - protein, 83 aa, synthetic construct
KLKFYQKLLKRIRREKCRVPQRRDAKEKTFKHCAARSRCYSLPLIMAAHRMRKRDLRASLTALFRCERHAGADLKLAPHFRER

SEQ ID NO: 1894 - protein, 33 aa, synthetic construct
KFKLLRRLYKKLRNRTLLSADAKYSSRRVLCIW

SEQ ID NO: 1895 - protein, 52 aa, synthetic construct
LMKFWRRLLKRWKTKYTNMRTNKLKANKVAADAYNYDRALHKRRRLKCPMHA

SEQ ID NO: 1896 - protein, 48 aa, synthetic construct
ILKLLKKFYKKMNCKIHANKHRLVALLALKMYKVKRAWCYTQNARGRA

SEQ ID NO: 1897 - protein, 49 aa, synthetic construct
RLKFLKKFWRRIRKKNNCNWKGLAALALLNNILKRACRVTAFELKLLIT

SEQ ID NO: 1898 - protein, 30 aa, synthetic construct
FIRFFRKLWKKLRHHKLASAGKPRLLNLRR

SEQ ID NO: 1899 - protein, 28 aa, synthetic construct
WFRYYKRIMRLMQSSLKAARANAFLRKA

SEQ ID NO: 1900 - protein, 69 aa, synthetic construct
KLRWYSKWIRLLKRLIKAIERLRLRKRILGNLKRLLNLHDKANMYKFSQAKRDHNFPAAHRVKARWLRF

SEQ ID NO: 1901 - protein, 85 aa, synthetic construct
YFRFIRRLIKRWKRGNDRRACARAFRQPQHPFKKLRYRRAENRRAARKSTEDAAFFLRLHAALGKWALKFHRGCRAKKGNATVWA

SEQ ID NO: 1902 - protein, 77 aa, synthetic construct
RLRMWRRMYRLFCPAKAKRAALQRKIKLMWLCKLGYRVFCIACKTTKAAKSRKVALRGKECHWMIVKKEAMKRLLNL

SEQ ID NO: 1903 - protein, 37 aa, synthetic construct
MFRFIKRLLRFIKTRARRDGALREAAKAHCATTERLS

SEQ ID NO: 1904 - protein, 80 aa, synthetic construct
IMRLMCRYIKLWRKLAWCQKPLFLARYSQLCAPKLTKFLKRACPYKCFRAIKKLPRAKLLMYRARWKQITKWKRVNLRRH

SEQ ID NO: 1905 - protein, 62 aa, synthetic construct
RYKYWSKILRKLRRAQSKLPLAELVAPLEAAVWRKMLAKYLRKGNVFLFKYLAHKRILRSCQ

SEQ ID NO: 1906 - protein, 39 aa, synthetic construct
RFRLWPKFLKLLKHRAAVMKAAIRDPILKRMLLMFERKK

SEQ ID NO: 1907 - protein, 30 aa, synthetic construct
KWRFMRKLIKRFRKFKYMFFAAADLLALNR

SEQ ID NO: 1908 - protein, 38 aa, synthetic construct
RFKLMKKLLRKLRNAPKRLVCRRNLGMWMWWAFWLLWR

SEQ ID NO: 1909 - protein, 62 aa, synthetic construct
RIRLMKKFLKLLKHICKGMSRWAYLLKMCAILCELKCPNDKFLADRKLWLCLHKRREKTRAK

SEQ ID NO: 1910 - protein, 85 aa, synthetic construct
RIRMLKRLIKKFRQMRSEGLKMARALRRRRKLKKRAEGTQLAPNQQMKFAHANCDFDKFPRHSLKLKYNTATSANKVLRAKVLLL

SEQ ID NO: 1911 - protein, 28 aa, synthetic construct
RFRLLKRLYKWFRSKILFKVSKWDAAAC

SEQ ID NO: 1912 - protein, 67 aa, synthetic construct
LLRWFKRMIRKFRTLRVRNHKCLWAASKPFRTKRCKMKCRVRLARLKTLLGAPLACSEPYQKMAGKL

SEQ ID NO: 1913 - protein, 40 aa, synthetic construct
ILRLLRKYLKKIRTNWALEGGRNLPAGFAKWLGALLRLMR

SEQ ID NO: 1914 - protein, 23 aa, synthetic construct
LFRLFKRFLKRYQRAAGHKQAFR

SEQ ID NO: 1915 - protein, 31 aa, synthetic construct
RLRLLQRFLRRLPRKSKLMIDYLRPLHLEAS

SEQ ID NO: 1916 - protein, 36 aa, synthetic construct
KYRIIKKIMKRLCKRTLAAYAEKLPADNMRNLAGLR

SEQ ID NO: 1917 - protein, 43 aa, synthetic construct
KLKIFRKFMRKLRKLAARAELVDKEKAICGAQTATKKHKQVLS

SEQ ID NO: 1918 - protein, 70 aa, synthetic construct
WYKFFKRLWRYLKKKSLTWANKERPRKGAKQCIAAKYAWYLGLLQVHAPLWLRKCRRAKWKAAGKGAKNL

SEQ ID NO: 1919 - protein, 31 aa, synthetic construct
MLKLIKKLFKKLPRNTSLKGAALAIKKGGGV

SEQ ID NO: 1920 - protein, 37 aa, synthetic construct
RLRFMHRFLKLFSSKLRHKLDFQAAARVRKRYLHRLK

SEQ ID NO: 1921 - protein, 44 aa, synthetic construct
RYKYFSKFFRRWRTRMAARPNKNSLLKLLLLLAWMAALQYHAVR

SEQ ID NO: 1922 - protein, 26 aa, synthetic construct
RMKLMRRLLRKFRQALRLNQNNAVGN

SEQ ID NO: 1923 - protein, 100 aa, synthetic construct
YLRYLKKFYKWLKKTLKSNLNDLKPLRFADRKLCPVEYLLKCFVKENARRTVRTKLLMKACLIRSRQRKDKLAWAANTNAVLKNRKTIRRRRLAIMAFRG

SEQ ID NO: 1924 - protein, 36 aa, synthetic construct
KFRLFCKILKRMRKLPRGPKAKALYSAGQLWKLAWW

SEQ ID NO: 1925 - protein, 25 aa, synthetic construct
RFKFWHKLWKKLKSAYGKELMAKLF

SEQ ID NO: 1926 - protein, 77 aa, synthetic construct
RIKLYRKLMKRFCRNLLLNWRLLWAQVFAKWINIVLLRAPEILVAAAVKRLRMECSLALKLGILKKGRRTALIHGMR

SEQ ID NO: 1927 - protein, 42 aa, synthetic construct
LFKFFQKLLKKIRSKLYIAALRMQLKRWNAALVFYRCVLHRK

SEQ ID NO: 1928 - protein, 21 aa, synthetic construct
FFRLFPRLLRLYCSRVKTAKL

SEQ ID NO: 1929 - protein, 26 aa, synthetic construct
KWRWWHKWLRKIKNAADAKLVNKAAL

SEQ ID NO: 1930 - protein, 58 aa, synthetic construct
KFRFLHRLLRLLRKLLRTILMAMKQFAWKRLRNLRSLLCTAFDKELPYLNAEALLRKR

SEQ ID NO: 1931 - protein, 20 aa, synthetic construct
WLRFMKRLMKIWCTLLEARA

SEQ ID NO: 1932 - protein, 35 aa, synthetic construct
KWKWLRKFLKRLRQALAWAEEEFWVNGKLLGCLKR

SEQ ID NO: 1933 - protein, 27 aa, synthetic construct
LFKFYCKFFKRISHAASLIKLDLRKKL

SEQ ID NO: 1934 - protein, 60 aa, synthetic construct
YLRWMRKFWKKFKPRVRRELIHRLAEKMKKQNPGLILYKFAKLRACLLGSRLHLRLLSMT

SEQ ID NO: 1935 - protein, 27 aa, synthetic construct
IFKLWNKFLRRYQTHLRKALTLRGAKR

SEQ ID NO: 1936 - protein, 33 aa, synthetic construct
RLKLMKRLLKFLRRLNWLLSALQFYWELNHKHW

SEQ ID NO: 1937 - protein, 53 aa, synthetic construct
RWRWMNRLLKLMTKELSLAWIKPLGARLKRAARAFDDWKKRHKVPANLDILKI

SEQ ID NO: 1938 - protein, 20 aa, synthetic construct
FIRFLRKILRRLQKAVLIKT

SEQ ID NO: 1939 - protein, 70 aa, synthetic construct
FLRWLPRLMRRLKCRAEPFARNLLHRCIGLRHKKRKNGGLALRQWWLLRSLMIEKIPAAAELAAAEALKK

SEQ ID NO: 1940 - protein, 38 aa, synthetic construct
LMRYYRKLLRRLKRVDALFDAVLTPKLNMNQLKKDMLH

SEQ ID NO: 1941 - protein, 32 aa, synthetic construct
KMKFLRKMYRKWKKLACRHRVRAAGLYLLPVY

SEQ ID NO: 1942 - protein, 39 aa, synthetic construct
IFKLWRKYIKLYKNAKIATAIRAAAARLIRTRKHRIMHK

SEQ ID NO: 1943 - protein, 33 aa, synthetic construct
WMRIFNRLLKYIRKLALAKLAAKKCAPFRSQTG

SEQ ID NO: 1944 - protein, 30 aa, synthetic construct
RYKILQKLLKKLKKQLRAPANIPCRWLKWT

SEQ ID NO: 1945 - protein, 37 aa, synthetic construct
FIRLFNKIIKKLKKALVGCKLCAKFCDKLRALRAHHW

SEQ ID NO: 1946 - protein, 40 aa, synthetic construct
KWRLLKRFFRRFRHESATKLFARSYRNSALLRLHFRVEKE

SEQ ID NO: 1947 - protein, 49 aa, synthetic construct
RLKWWSKLMRRLKNAELRMCNGCQHPFCRALRARNRARRAKRIWRDPAA

SEQ ID NO: 1948 - protein, 40 aa, synthetic construct
RIKFLRRYYKFMRNKMLNRPKRLVAIAATAHGWTLKAWAR

SEQ ID NO: 1949 - protein, 33 aa, synthetic construct
KLKWMRKMWKMFKKKRCANLLARRLLKLKLAPA

SEQ ID NO: 1950 - protein, 50 aa, synthetic construct
RIKLMRKLYKKIKKIELWLRAADRKIKAANRRQAHAKMKAQRFLCFDMRL

SEQ ID NO: 1951 - protein, 42 aa, synthetic construct
RLKLLKRLMKRYTKKLKSCKALCKQCLMSHGTKAGRLKVWMM

SEQ ID NO: 1952 - protein, 33 aa, synthetic construct
RWKLIRKLLRKLTRKAQRYLQGAIKLVPGNFYA

SEQ ID NO: 1953 - protein, 20 aa, synthetic construct
ILRFLQRILRLWKCKKNACK

SEQ ID NO: 1954 - protein, 48 aa, synthetic construct
MYRLFRRMLKLFTKKRLRKINARACMLDSSPKGRAYLEARAVFARDYK

SEQ ID NO: 1955 - protein, 20 aa, synthetic construct
FLKFFKKLMRMLSQLAALKS

SEQ ID NO: 1956 - protein, 35 aa, synthetic construct
KLRLLQRWLRRLQKLHVRGAMQFACCIDKRLAFAP

SEQ ID NO: 1957 - protein, 98 aa, synthetic construct
LFRFLRKLLRKIRSYWEEKPRCRRSARAADATWLGKRRLSKAVRLIKMPAELWHKKLIQMRRIDQVNLRGLKANHKLKRRKAGLIRAPAILFMKTKLF

SEQ ID NO: 1958 - protein, 38 aa, synthetic construct
RFKLIKKLLKLIQKFGACFYLFAKAWAQADELLYCKQR

SEQ ID NO: 1959 - protein, 70 aa, synthetic construct
KYKLFCKWYRFFRRLDCQRKLRRANARRAPKLPKARAFLVRSSFRLGRFKRPPHELSKLHNLLKEMDRAL

SEQ ID NO: 1960 - protein, 50 aa, synthetic construct
KLRLLPKFLKILSKIDKARALQRAIARRKHKLWAKKCIKCMAMKNLPLRL

SEQ ID NO: 1961 - protein, 60 aa, synthetic construct
LMKFMRRWLRKLSSPLYRKQARKERLVKMTKKYQIQKRFKAEKQCAYVAAVKYLLAAFKA

SEQ ID NO: 1962 - protein, 45 aa, synthetic construct
FLKLIRRFIKKLKRTAENRASLQCRAGKALWVASNRQHAHARRSF

SEQ ID NO: 1963 - protein, 56 aa, synthetic construct
KFRLLQKFFKKLRKLFYLARDTMLLLKNRARPHIAESDKDARTMLLKLSLKMFGSL

SEQ ID NO: 1964 - protein, 73 aa, synthetic construct
MLRWYNRLFKIMPQKRGDSKLFLRAVLKPTRRNLEVTLLKRTRAEARDFCKAADLRKRAIRRNCLKLLGWLLR

SEQ ID NO: 1965 - protein, 72 aa, synthetic construct
LYRLFHRLFKLLRQRSADPTNTAQAKKQKLSRLGRADEARRNRRAIRPWLKAGKMDRGARAPKKLYKIAGLL

SEQ ID NO: 1966 - protein, 58 aa, synthetic construct
KLRLFNRLLKKFTKWCREAKRNRKALHVCVKIAAPKRNLARLGRRRWARAGAARVGIL

SEQ ID NO: 1967 - protein, 41 aa, synthetic construct
KLKLYQRYYKKFTPSKGALIKKDWHWYLKLKNARLFARALA

SEQ ID NO: 1968 - protein, 23 aa, synthetic construct
KLRYIRKMLKWLCRLYLSAGPKS

SEQ ID NO: 1969 - protein, 22 aa, synthetic construct
RYRFLPRLLKLFNRAAVFSKRW

SEQ ID NO: 1970 - protein, 32 aa, synthetic construct
KLRLMPKFWRRYRCQRARFEDALAPNRALKYV

SEQ ID NO: 1971 - protein, 27 aa, synthetic construct
KWRWLRKLMKMYQRYAYLKSKGGLLAK

SEQ ID NO: 1972 - protein, 23 aa, synthetic construct
LFRILRRFLKILKSLLGLKRCER

SEQ ID NO: 1973 - protein, 23 aa, synthetic construct
MFRLLRKYIRLFRNLKMKAHGCA

SEQ ID NO: 1974 - protein, 27 aa, synthetic construct
WLRFFSKFLRLWRKRWTSLLRAELRAK

SEQ ID NO: 1975 - protein, 26 aa, synthetic construct
RFRLFQRFLRFLKHFKALLRASTSAL

SEQ ID NO: 1976 - protein, 31 aa, synthetic construct
MMRLFQKLWRRYKRAMRDSLAKANALGKEKF

SEQ ID NO: 1977 - protein, 30 aa, synthetic construct
LIKMIRRILRRMNRTKAAMKSQAAAWPKHA

SEQ ID NO: 1978 - protein, 45 aa, synthetic construct
RYKILHRFIKYYCKMKKCDAVLKKLALWLKKRLWMGLKKCSHLLL

SEQ ID NO: 1979 - protein, 25 aa, synthetic construct
YYKLLCRLFKFWKQEEVRRLKWRAA

SEQ ID NO: 1980 - protein, 23 aa, synthetic construct
WLRLFSRFIRRWRRAGAARHSTA

SEQ ID NO: 1981 - protein, 64 aa, synthetic construct
LWKLLKRFFRWIKPARRAAASLLKALARPRLRVQNLRTPMTYRRLLMAMPGAPRQAQLHAPGNV

SEQ ID NO: 1982 - protein, 44 aa, synthetic construct
KWKLLKRWIKKLRKTDYLNAYNHENLDSMVLKYARRKPERLAAR

SEQ ID NO: 1983 - protein, 43 aa, synthetic construct
KMRLLTKLLKRWQKKDQADLKWYQVMRRFLDVAHCLAAALRYP

SEQ ID NO: 1984 - protein, 58 aa, synthetic construct
RLKLLKKLYKRFCRQHARFRFKIGQKLKHRELGRKVAAIWSRQDQVASTRRAFLLLKC

SEQ ID NO: 1985 - protein, 24 aa, synthetic construct
LLRMLHKMLRLFRKWKKPRYAFAW

SEQ ID NO: 1986 - protein, 29 aa, synthetic construct
IMRYIHKLFKWFRHLRQANSAALAKRARR

SEQ ID NO: 1987 - protein, 47 aa, synthetic construct
KLRFWKRMFKRLTRWLTSKQPLEDARLKKLWKRLRELHKSAANHAAL

SEQ ID NO: 1988 - protein, 69 aa, synthetic construct
RFRWLTKMLKRWCRTLYTLCNRRSAWKARMNRAKNGYRALSAVKQALMMGAQSLQARALARRWRRRLDV

SEQ ID NO: 1989 - protein, 67 aa, synthetic construct
RLKLIHKLFRLLKRLDRNRTRKFRQRGASKALRWLAYQTLMALKRIKIMCRLACKALVRMKTTWIFA

SEQ ID NO: 1990 - protein, 92 aa, synthetic construct
KFRWLTRWLRKWKNPLDRRLHMLRHARTCRAKKKKEGADIIWRNLAMKYTSQLFHKDAVRAKRLRFAALARRLRIADATRRIANIKKHKDAL

SEQ ID NO: 1991 - protein, 32 aa, synthetic construct
KLRLMHRLMRKWSKVLKVLRWLHKALFHKTFI

SEQ ID NO: 1992 - protein, 33 aa, synthetic construct
KLRMWCRLLRRMNRMQIDGANMAPAFAALLLKK

SEQ ID NO: 1993 - protein, 20 aa, synthetic construct
LFKMLRKILRRLKCELYPDA

SEQ ID NO: 1994 - protein, 49 aa, synthetic construct
MMKWIKKLLRRLRRLTLRIPPRADALDATWRSECFKKFLCIALHLAALD

SEQ ID NO: 1995 - protein, 20 aa, synthetic construct
LYKLWRKFLRKLKNDASPFC

SEQ ID NO: 1996 - protein, 36 aa, synthetic construct
LMRLFRKLYKILKNARAERLEHMGFYYLKRPALEKQ

SEQ ID NO: 1997 - protein, 23 aa, synthetic construct
LMKYLTKFLKRLRRRAGDVMKLW

SEQ ID NO: 1998 - protein, 31 aa, synthetic construct
RLKFLTRMLKKFKRALDERRRRLLWLPGLCR

SEQ ID NO: 1999 - protein, 27 aa, synthetic construct
MIRLLKKWFKRLCSLYWDKRAAIAKPA

SEQ ID NO: 2000 - protein, 65 aa, synthetic construct
FFRLMSKWLKLLKKYCHSKCCGAAAVDHLKLANSWQKEALREKYAKDKPYKPLRVARAAKDLRQK

SEQ ID NO: 2001 - protein, 77 aa, synthetic construct
LFRILSKMLRFLKKKMNIQAACKRNKLARCMWPKGLRLRARRRRANAAQEKCMFEGRLLAILCCLTPDKSQLLAAMF

SEQ ID NO: 2002 - protein, 54 aa, synthetic construct
LFRFFTKLFKLISKLRKCRTKYRMRIRALAARSPAKEAWKLLLKFAKPQHLDEI

SEQ ID NO: 2003 - protein, 39 aa, synthetic construct
KLRIFRRLWRFYKRLLRKEMAVADARYRMQRAPNADLPF

SEQ ID NO: 2004 - protein, 39 aa, synthetic construct
KIKLWPKLIRRICSHRICANKKLARMLIRKAAAYLKITA

SEQ ID NO: 2005 - protein, 25 aa, synthetic construct
LFKLLTKFYRKLTKSYGLKAHATKW

SEQ ID NO: 2006 - protein, 93 aa, synthetic construct
LWRIYKKLIRRYRCRQRRLRHASRHNPKSAAMDKLNLRENKRSKLRLALMLHRARRADAKAFICAALHGHCWWIKPAHRKCLRLAADEKLVAR

SEQ ID NO: 2007 - protein, 39 aa, synthetic construct
RLRLLPRYWRKIKSKTLRAWAVYTIHRMLCERLKLLRLV

SEQ ID NO: 2008 - protein, 55 aa, synthetic construct
YWKLWRRIFKFLPKGKACHCKKACKLAQRLALAMMCLKKWVARRKADLNLKLTLN

SEQ ID NO: 2009 - protein, 20 aa, synthetic construct
KMKLIRRFLKMMKQQTAYLA

SEQ ID NO: 2010 - protein, 87 aa, synthetic construct
RFRWLRKFYRYFSRSHSHKAAKRRRTRLLLRRTSLGAKYQSRLFKERCKLKKLKCCKRALMNWRAFKALHHQTSAKDRKTLLLHYAH

SEQ ID NO: 2011 - protein, 43 aa, synthetic construct
IIKLFSRLIRILRRGRYAHLAMCNKSAHLAKSLKFKRMAKILC

SEQ ID NO: 2012 - protein, 20 aa, synthetic construct
LLKLISKLFRRFHQDKKASG

SEQ ID NO: 2013 - protein, 37 aa, synthetic construct
RLRLWRKMLRMFRRTARMRGLLGSAHPCRAVYLLRVR

SEQ ID NO: 2014 - protein, 57 aa, synthetic construct
LYRFMPRLYKKLRKQRPAAMAKLLYEFLHCKTAPRRLARLKALLHFLGLILKLKIWC

SEQ ID NO: 2015 - protein, 57 aa, synthetic construct
MMRLLKRLFRLFHRDWECAVHPQRRDQLKNFGTLLRCKLRRAALRLKALEHDRRVHK

SEQ ID NO: 2016 - protein, 70 aa, synthetic construct
KLKLIQRLWRYFCKEDRKHRECLLRRGDRMKRKLHAAGKLKLIAMMLIIKASFLRKRANAKLVGWIRSFP

SEQ ID NO: 2017 - protein, 98 aa, synthetic construct
MLKLFCRFMKKMKRMIAMARADAGKEKFIVVHPATRKELTIYKMNKDKLLLMVLHLKDAARRAKKLPQLTKGRSYAAAASAKRAYDLATVAADKKRCY

SEQ ID NO: 2018 - protein, 76 aa, synthetic construct
KLKIMRRFMKKLKNTGAKYGAWKQAYYAAKAAAVRANKKNKYEHAKSADDKERRAWARLLCNARKQTGWDRLGGER

SEQ ID NO: 2019 - protein, 37 aa, synthetic construct
WYRFLRRFLRLFKRRNWLARFNLDLRLPFNAKAKCRN

SEQ ID NO: 2020 - protein, 30 aa, synthetic construct
RLKLFKKIMKRLSRAFYPLLQGLKWVLKLK

SEQ ID NO: 2021 - protein, 72 aa, synthetic construct
FLRFMKRFFRRMQRRLARKYTHKTPLCRKMHGSDLAQKRRLLVAPRKAWKKRCLLLIAKVLKKIRCYVVAAE

SEQ ID NO: 2022 - protein, 70 aa, synthetic construct
RLRFLHRFMRFLKHMTKACALWAKEGRKRFRRRQLLWRRLEICQASRTRLLDKLLALKQINAAIDSFNHK

SEQ ID NO: 2023 - protein, 27 aa, synthetic construct
KLRWLRKWFRLWKTALEQNRLILAKCR

SEQ ID NO: 2024 - protein, 24 aa, synthetic construct
KLRLWKRFLRKLPRSLMGKWRALA

SEQ ID NO: 2025 - protein, 78 aa, synthetic construct
WWRFLKRIFRRFSRSLLRKPIQYHHALLLLSLALALRKPKKKNKDAAQRRYKKKMILDDPQKFAALILFERNDLVNNL

SEQ ID NO: 2026 - protein, 38 aa, synthetic construct
KLRMLSKLFRKLRKKAKRCNRGWMFPDKLPLALAMGAL

SEQ ID NO: 2027 - protein, 61 aa, synthetic construct
RWRLFKRYMRKFRTQLLVGRVKRRLRYARLAAGAALARQLETVATNARILTYWRWVYASAT

SEQ ID NO: 2028 - protein, 79 aa, synthetic construct
KYKMMNKLLKRIKRWAKDLQRIKKAMLAARMLLRHIAKQLEPIRVKNSLYCVLMDGRLAMRQLMPWRARARRHYRAPAP

SEQ ID NO: 2029 - protein, 25 aa, synthetic construct
FFKLLKRLLRRMKRTCKNWLLCTCV

SEQ ID NO: 2030 - protein, 27 aa, synthetic construct
RFRLFQRWLKIIKKRQALREAAQKVLA

SEQ ID NO: 2031 - protein, 38 aa, synthetic construct
RFRWLQKMLRRFKHLKAILACLRAIAIAMGKQMDRKKC

SEQ ID NO: 2032 - protein, 53 aa, synthetic construct
RMKWIKKWLKLMRNLTEKLFPALCFAMWALKAKALRKYRRPNGECEWRRALAA

SEQ ID NO: 2033 - protein, 74 aa, synthetic construct
RYRILKKFLRRLPSLHKRRVYNLFDHAEDNPSAAALCLRIALNLALAALLKMAQQRFRLSREKHASRRFRLKMD

SEQ ID NO: 2034 - protein, 38 aa, synthetic construct
LMKWIKRFFRWLQTLRLFLKRGHLRRKRWLACKLTHAL

SEQ ID NO: 2035 - protein, 34 aa, synthetic construct
KIKLMRKFLRRLCRKLTRDTELRACLWGQDAWCR

SEQ ID NO: 2036 - protein, 29 aa, synthetic construct
LIRYLNRLWRLLNKLSPRYLDARRLSKSD

SEQ ID NO: 2037 - protein, 20 aa, synthetic construct
LIRMMHKFLRLLRRKFAFDK

SEQ ID NO: 2038 - protein, 33 aa, synthetic construct
RLRWFPKWFRIWNHRLLMKAAKRHHLRGKQLRA

SEQ ID NO: 2039 - protein, 32 aa, synthetic construct
KLRFFRRFYKLLCRRSKNAALHWLAQLGGTAE

SEQ ID NO: 2040 - protein, 93 aa, synthetic construct
KWKLMTKLIKLYTNLEALASLAKLKRMASYTNPKTHTWRAFNKCKRWSMLAKEARPARAHNDKANKNKACVLARNPRAKYKARAPRLTLCAPR

SEQ ID NO: 2041 - protein, 42 aa, synthetic construct
KLRWLPKFFRLFKHRKSPSLLKFKALLLAECAKHLRETGKWP

SEQ ID NO: 2042 - protein, 20 aa, synthetic construct
RLKLLNRWIRWMCRRAAQVN

SEQ ID NO: 2043 - protein, 20 aa, synthetic construct
FMKLFRRYLKKLSQPLASCA

SEQ ID NO: 2044 - protein, 74 aa, synthetic construct
KIKFLHKFLRKMKTRLVWPNLPMCKYAAARPAYKKRAKAMWQARNRRLRWYDADRSFRRSAKHLKANRAWRLMY

SEQ ID NO: 2045 - protein, 60 aa, synthetic construct
KLKMFHKWIRKLQPNRMRSKLRMLALCLYKAKLKLSLPSYKRLHVKFMTKALFAFPRRKP

SEQ ID NO: 2046 - protein, 70 aa, synthetic construct
KLKFMRKMYKMLKSRAMLVKEWGNPAALPRGAGLMTARKAWDNKKKAEFAINLGARLNMRKTKDAIAALA

SEQ ID NO: 2047 - protein, 33 aa, synthetic construct
RLKIMPKFFKKWKKALLARLSWAKEAASWRKTH

SEQ ID NO: 2048 - protein, 40 aa, synthetic construct
RFRLFHKFLKRIRCHAKKAMTLRAEGRKSLADHLQRLQGT

SEQ ID NO: 2049 - protein, 48 aa, synthetic construct
KWKFFKRIYRLLKHAAKKAMFHDDLALDALRTAKSRPKDVKARKYLFP

SEQ ID NO: 2050 - protein, 80 aa, synthetic construct
LMRLWRKILRWMTTMRTCKWEVKNYWPLRLKHALLTALKRRCIQSKDILRLAVLGNRAALLKKRKDMLLPAMAPLAIIRA

SEQ ID NO: 2051 - protein, 40 aa, synthetic construct
RLKWYNRFLRRLTKEATANAKKVFDMALARLDHTRCKNAR

SEQ ID NO: 2052 - protein, 43 aa, synthetic construct
LLRLICKWFKLLRKLRCCRLLLKNFVHALIASLHCWRSARCKA

SEQ ID NO: 2053 - protein, 21 aa, synthetic construct
WLRFLKKILKKYTRIARLAIA

SEQ ID NO: 2054 - protein, 99 aa, synthetic construct
KLRFIRRIMRKIRKNKVLLLAARLKARAGKEQEQRKKALRIIRGSWKLMLKAWLMKNALVQALMKLAYHFRKGCRKYQYRAKANGPRLKPQKKELAVPK

SEQ ID NO: 2055 - protein, 51 aa, synthetic construct
KLKILKRYMKRIPKAKSKLENLALKYLKYVLLKREGILRRIECISKRATIA

SEQ ID NO: 2056 - protein, 23 aa, synthetic construct
LLKLLHRIWKLFRRCNMRAAAIS

SEQ ID NO: 2057 - protein, 72 aa, synthetic construct
KLRWWKKFFRRLRQRTASWFGMKSFLCVGKFALNLKALARRKAKYQFLLYKAADSKIGALKAGRKLRDDSGA

SEQ ID NO: 2058 - protein, 59 aa, synthetic construct
ILKWLKKLLKRLKKKKHPQHALEKVENGAAIRWTCKHLPLMIAAKLKYMKFKALPARLM

SEQ ID NO: 2059 - protein, 21 aa, synthetic construct
MMRWYRRFLKRWRKAALLADR

SEQ ID NO: 2060 - protein, 52 aa, synthetic construct
KYKFIQKFLKLFKKASLKALPGAAWGELSILKLALMKIKTCRDLSIEWKKKR

SEQ ID NO: 2061 - protein, 29 aa, synthetic construct
LLKLLTKYFKFYRKLAYYSSFHKFKLPKK

SEQ ID NO: 2062 - protein, 70 aa, synthetic construct
RMRLLKKYLKKLRRRLIGRRWMNNACLRSLKADPCSAELALMCCLRLDELFLARDKDRLKSKAMRNIPNF

SEQ ID NO: 2063 - protein, 53 aa, synthetic construct
KWKFWNKLFKYFRRIGWRRAKAWLKKAKAEPQTPMLKRRRCGPLLLLHLAGYK

SEQ ID NO: 2064 - protein, 48 aa, synthetic construct
FFKYYKKLLKFLTRLLKKKKCRRPTWLARAACWAKSRGMMNYAPRKQA

SEQ ID NO: 2065 - protein, 67 aa, synthetic construct
LIRFYNRWMRKWRKSKLTVELLCGAPRSFLTWLEWAQNLRIKRSLARPIYLLNKLRKARATLRLNAA

SEQ ID NO: 2066 - protein, 72 aa, synthetic construct
YWKLLRKFYRWMRNKYFQTKIRKKESGALAALRLKPRLCKFFERKKRAHLAACMLYLYRKLALGNLLELRLR

SEQ ID NO: 2067 - protein, 24 aa, synthetic construct
LLRILKKLLKRFHRKAQRVNAFRD

SEQ ID NO: 2068 - protein, 36 aa, synthetic construct
FFRMITKLMKRWKHKLMAKAAFKKKTALWKLRGSNL

SEQ ID NO: 2069 - protein, 30 aa, synthetic construct
MLKFFRRWLRKLKQLKPMLWVKAGACDKLL

SEQ ID NO: 2070 - protein, 70 aa, synthetic construct
RFRLWRRFWRKMSRFDKNARWRKASPFALAWWASKIRCREARTVSLQAKVQNKLEAPRLAALLRAMALEL

SEQ ID NO: 2071 - protein, 81 aa, synthetic construct
LLKLMRKLFRFMTHKLQTCFRRLVKLLAGPRYRAKLEKLRLTVRMKRAGTAKALNRPLKKQRYGIAVSFLPRRFFTMVARV

SEQ ID NO: 2072 - protein, 82 aa, synthetic construct
LFKIYRRFWKKLHKWTLHRGLLALAYQLRGAWNRFMTARRMAASRKKQRHKSPRKLRYKALRADFNILATKKLQTAYWCLRS

SEQ ID NO: 2073 - protein, 27 aa, synthetic construct
RLRYWKKILRRLKSLASNKATNYIRLP

SEQ ID NO: 2074 - protein, 25 aa, synthetic construct
KLRLMKRWMRKLSRDRPAAKLLYYL

SEQ ID NO: 2075 - protein, 50 aa, synthetic construct
RFKILKKYLRIFSRAKVTLLRRCRIRWPLALNQLVRAQRFAAMKALRLVK

SEQ ID NO: 2076 - protein, 27 aa, synthetic construct
FWKIFPRLFRLISTHALAWDRKLKAKL

SEQ ID NO: 2077 - protein, 21 aa, synthetic construct
RWRLMPKLLRMLTKWAKQRQD

SEQ ID NO: 2078 - protein, 20 aa, synthetic construct
KYKLYKKLLRLLRCMGQGLF

SEQ ID NO: 2079 - protein, 23 aa, synthetic construct
WFKLLNKMFKRMTRELYKLEARA

SEQ ID NO: 2080 - protein, 25 aa, synthetic construct
KLRWFKRLWKKMHKMKLTHKAALVL

SEQ ID NO: 2081 - protein, 25 aa, synthetic construct
FYRFFRKFLRLLKHLKWDAVNRAFA

SEQ ID NO: 2082 - protein, 36 aa, synthetic construct
RLRWLSRLIKMFQRCKDCLAGLVKRLGKLKDYNGAA

SEQ ID NO: 2083 - protein, 20 aa, synthetic construct
YMRYLRKLLKKLQKLWQKVE

SEQ ID NO: 2084 - protein, 69 aa, synthetic construct
LLKIFKRFIRRFSRRRAIVLKIHMRVHLKALPKLLKVRLEARDAYDPEKLHYRWLLNLCALLSAQDLWK

SEQ ID NO: 2085 - protein, 37 aa, synthetic construct
KLKLFRRMLKKMKKIMELGRYWKAPAVLCLDKALWGI

SEQ ID NO: 2086 - protein, 24 aa, synthetic construct
RYRWLRRLYRRLKNFYKWAQARAL

SEQ ID NO: 2087 - protein, 20 aa, synthetic construct
LLRLMKRFFKFFRRAREACA

SEQ ID NO: 2088 - protein, 30 aa, synthetic construct
ILKFIKKLLKRMKKDLLDKDAVQLYKIHLL

SEQ ID NO: 2089 - protein, 61 aa, synthetic construct
MFKLFKKIFKKFRHALGGITLRRAKGRNLTWKRQRRRAPPYRLAILRAKHRIAAVKAVAIT

SEQ ID NO: 2090 - protein, 23 aa, synthetic construct
KLRILRRLMRKFRHKLLALLPLR

SEQ ID NO: 2091 - protein, 36 aa, synthetic construct
RIRWLNKFLRRWQSGRKLKGRLMPNYALALLFLRAE

SEQ ID NO: 2092 - protein, 34 aa, synthetic construct
MWRLWRRILKKIKRHKWLLWTLAIARAYILLAEL

SEQ ID NO: 2093 - protein, 38 aa, synthetic construct
MLRFLKKLIRRWQKMLYLSARFTALAYRHAVKWAVTIK

SEQ ID NO: 2094 - protein, 27 aa, synthetic construct
KLKLWKRFFKKFRRAANNPAAQLKSSF

SEQ ID NO: 2095 - protein, 50 aa, synthetic construct
KLRLIKRLFKRWKKAAHRDKWMYNAAQLQVCRALNRDSAFHRLLSLRLKM

SEQ ID NO: 2096 - protein, 38 aa, synthetic construct
KLKMIHKLMRWLKKLLRELKLMQLLEAQKQLLMQEAKR

SEQ ID NO: 2097 - protein, 83 aa, synthetic construct
KFKYFRKLFRWYCKHAKKARHKSAAMRRLKEVLQRDQKLMRLLNLLRKLGRKEDPPAAPACAYRSRAQADSAYFAKTTKTERG

SEQ ID NO: 2098 - protein, 48 aa, synthetic construct
RYKFWQRFMRRFKKVKAIRFKRLANKAKACALDNLLWRKAAHNQQMLL

SEQ ID NO: 2099 - protein, 33 aa, synthetic construct
KLRFWRRFMKKLQKNRTRDRNHCAPIMAKLLLL

SEQ ID NO: 2100 - protein, 20 aa, synthetic construct
RMRLYCKFLKKMHRILLLIK

SEQ ID NO: 2101 - protein, 34 aa, synthetic construct
KFKLLNRLLKRLKSVFMKHIRMKKALRAARHLAA

SEQ ID NO: 2102 - protein, 33 aa, synthetic construct
RYKFWRKFFKFLRKMDGLGLRAFEKGRLLKPLL

SEQ ID NO: 2103 - protein, 23 aa, synthetic construct
LWKLLNRIYKLMKKRKSKDLAAK

SEQ ID NO: 2104 - protein, 85 aa, synthetic construct
LWKLWKRWYRFFSRKPLREGFLILDLDARLAALPKCEKARRYAARKWKKMSARARCKAAQQCTRNREGLKQLLIAKDAALKCGKL

SEQ ID NO: 2105 - protein, 22 aa, synthetic construct
KLKLLNRLFRFLRKATPKKFLN

SEQ ID NO: 2106 - protein, 25 aa, synthetic construct
RLRFYSKYLKKLHRKCASKYPLPLQ

SEQ ID NO: 2107 - protein, 26 aa, synthetic construct
YIKLFKKFLKFLRCAVHKLKAASKGL

SEQ ID NO: 2108 - protein, 34 aa, synthetic construct
KWKLLSRWFRKYCKLWAIALRPMRKGILPAKAYR

SEQ ID NO: 2109 - protein, 36 aa, synthetic construct
FLKLLKKFYRILKRCQRRKAMPYKDLTCASKLLNMA

SEQ ID NO: 2110 - protein, 53 aa, synthetic construct
LLKFMKRMYRRLNRAYLAFAICPRKSCKQQYNRKRARMRKLRCLLRGGALNCR

SEQ ID NO: 2111 - protein, 27 aa, synthetic construct
RLKMYRRILKKLRKHRADMRPALRLAA

SEQ ID NO: 2112 - protein, 73 aa, synthetic construct
FMKYFRRWFKFFRCANFSGLALAQKYRLFTLRAILHYRLQARRKRACTWRRKERLCFQREKVAAPGKLAALLL

SEQ ID NO: 2113 - protein, 51 aa, synthetic construct
RLRWLSRIFRRFQRLARAMWEKRYKALPDLYDRMEKKKLPEAPAALNRAGK

SEQ ID NO: 2114 - protein, 20 aa, synthetic construct
LFKLMKKMFKLLNKLHAHYV

SEQ ID NO: 2115 - protein, 48 aa, synthetic construct
RFRMLPRLMKKWRHDKAQLFHALRALKQWGARAAHLKCRGKRARYMTC

SEQ ID NO: 2116 - protein, 20 aa, synthetic construct
ILRMIRRFIRRLKKLLHPYA

SEQ ID NO: 2117 - protein, 39 aa, synthetic construct
FFKFLTKLLRWMRRAAAQALVRAIPSYAKGSYRRKPAHL

SEQ ID NO: 2118 - protein, 37 aa, synthetic construct
KLKFWKRWMRRLHKHAKDHLHRMYMTARALNALSARE

SEQ ID NO: 2119 - protein, 24 aa, synthetic construct
KWKWLQRLWKLFNKVLPKQLKQKL

SEQ ID NO: 2120 - protein, 42 aa, synthetic construct
IYKYLRRMFKKLRHAVWKKKLHRGNHALRMYLNAMLLAHKRL

SEQ ID NO: 2121 - protein, 40 aa, synthetic construct
YWRWFKRLWRKFKHPPRLILAKRFVLAQRDGDLWKDRKLL

SEQ ID NO: 2122 - protein, 33 aa, synthetic construct
KFKYINKLWKLWRKKAPICLPLATIRKKLKAQC

SEQ ID NO: 2123 - protein, 30 aa, synthetic construct
RFKFLPKLFRYWNKLLELRSLRHALPALAR

SEQ ID NO: 2124 - protein, 43 aa, synthetic construct
RLKYIKKLLKKLRNALQKLKLDREKSYWNGRSVAYLYAIACME

SEQ ID NO: 2125 - protein, 60 aa, synthetic construct
RMKWLKRLFKRWKTPTPAAALIEKSLLRNVLRPLAQALKHKWAKCMHWRFLSTKYPAHRL

SEQ ID NO: 2126 - protein, 47 aa, synthetic construct
LFRYLKKFLRKFPRRTLLLCQRRSAAYAFLFLFAQRVAMRRRARMKK

SEQ ID NO: 2127 - protein, 31 aa, synthetic construct
YLKIIRRLLRLLRRNLKSFRCFAPVQLARCL

SEQ ID NO: 2128 - protein, 29 aa, synthetic construct
MYKILCRILRLYHKRRQLIRCEAIALLNL

SEQ ID NO: 2129 - protein, 80 aa, synthetic construct
IWKIFKKFLRRMRKHYKALTYMRRMLATMWHKARKRRRFAGAVRDAGPLLHCACRRAYFVKKRKQKYLILGLCARNLVRH

SEQ ID NO: 2130 - protein, 42 aa, synthetic construct
KLKLFHRMLRRMCRGLYAEMRLRRLKKGHFFSWLKALALSHD

SEQ ID NO: 2131 - protein, 47 aa, synthetic construct
RLKLFKRYYRKLQQKMSKLALQSTWELARWLLLPREFTAYTKDELAR

SEQ ID NO: 2132 - protein, 24 aa, synthetic construct
RLKLLHKMYKKMTRPRFRLMLLPW

SEQ ID NO: 2133 - protein, 56 aa, synthetic construct
KYRYFKRLLKKFHQTLCARRKALWRLNRLCHLLASQKCAPCHEIAIKKILPVATAR

SEQ ID NO: 2134 - protein, 23 aa, synthetic construct
KLRYLCKWFKRIKTLALAYARVT

SEQ ID NO: 2135 - protein, 52 aa, synthetic construct
RYKFIKRWYKKITSLDLRWLLNAEVSWRSKEQALRALLLAGELGKYAARAKW

SEQ ID NO: 2136 - protein, 54 aa, synthetic construct
WLKLMRKLIRRMCRTPAELKLVAKSEYCDRARAGKDKTSMRLKKWTAWKARDRL

SEQ ID NO: 2137 - protein, 62 aa, synthetic construct
KFRMMHKLFRIFRSIWRVLRPARAAALDAELHAKTRCARLKTNRLIAKKEATKRKCSLIEAS

SEQ ID NO: 2138 - protein, 40 aa, synthetic construct
KLRLFKKFLKRMSKWYLAADGAALACRIEEDMRFVGSLRL

SEQ ID NO: 2139 - protein, 35 aa, synthetic construct
KMKLLRRMLKRLNRACNDYRLNCWLPADRGRAACA

SEQ ID NO: 2140 - protein, 31 aa, synthetic construct
LIRFFRKYIKRLNKADLRQLKQAAYRCRANL

SEQ ID NO: 2141 - protein, 25 aa, synthetic construct
KMKWWRRYFRLLKRWITLKDAELSA

SEQ ID NO: 2142 - protein, 41 aa, synthetic construct
RLKLFKKLWRLWTRLRAIQHVALKSFALRWLQDYLKFAQIE

SEQ ID NO: 2143 - protein, 84 aa, synthetic construct
MYKFLHKLWKKFTRRLVQLPPYLAYIRLRPRRLRLHLKANKQWRFYDYRPLNAGIIRLNLAKKAASACKLLRRRRPMLNTARFY

SEQ ID NO: 2144 - protein, 66 aa, synthetic construct
KLKFLCKYFRWLRKWVIYTIPLELNPIVASKARRFAAWKKAKLQRKERNRLAKKNLLTAKSTEKKG

SEQ ID NO: 2145 - protein, 64 aa, synthetic construct
RFKFLCKLLRRWCRLLRRLKALNWCLLGVKHPLFRALEYSAGMAAHTMDVPRLAARKFRWLRWQ

SEQ ID NO: 2146 - protein, 46 aa, synthetic construct
YLKYFKKFFKLLRCKSLIFPAARLLFAMKERRCHALQRCRLKAASK

SEQ ID NO: 2147 - protein, 20 aa, synthetic construct
RLKWFHRFWKKLKCALDHAL

SEQ ID NO: 2148 - protein, 55 aa, synthetic construct
RMRLYRRFYKKMKRIRKRKLKELLILHVLFMRAAKAYLALTRTHLRAKAAHRDDI

SEQ ID NO: 2149 - protein, 45 aa, synthetic construct
FFKMYRKLLKLFKRARARLTGALAYERAVCFRAPDHALSQLIQKC

SEQ ID NO: 2150 - protein, 73 aa, synthetic construct
RLKLIRKLLRKWRRMLPCAHRHRKLLRAAKTAALFSIKWIKAFDTGLRRCRLMKLAGWRKAKCKIRQLKMATF

SEQ ID NO: 2151 - protein, 80 aa, synthetic construct
ILRLWRRWWKRLKKCWLAKQAHKRCKERLWLCLELIASFCCTKVRKRRTEKFLIRRFLQLLLLAGSDCNTLKYKRWARND

SEQ ID NO: 2152 - protein, 24 aa, synthetic construct
RMRLLRRFWKKYNQLKLKLLQFMD

SEQ ID NO: 2153 - protein, 26 aa, synthetic construct
LWRYLRRWFRLLKRHDMRLLLGRAPH

SEQ ID NO: 2154 - protein, 36 aa, synthetic construct
WWKLLQKLFKRIRCEWHLSPRLKELLHKLLLKRRCA

SEQ ID NO: 2155 - protein, 59 aa, synthetic construct
RLKLFKKIIKKMNKRLDSEAKWAVDTWAKLELWKFKKRKCCICLKAAAGRIRASMLGKV

SEQ ID NO: 2156 - protein, 61 aa, synthetic construct
RFRLWNKIIRYMKRLFKKLQRSAALRALKLSYKRLCQLCWAAAAVTARGWKELEALDALAK

SEQ ID NO: 2157 - protein, 36 aa, synthetic construct
KLKWWKRLMRYFRQPLARHMADQWATRKRNEAWLAL

SEQ ID NO: 2158 - protein, 51 aa, synthetic construct
RLRMLKKWMRKLKCLAHVKAIALGLKARRWALKMFLGEPCIKLIWFKWRKK

SEQ ID NO: 2159 - protein, 68 aa, synthetic construct
KWRLIKRIFRFIRRKLCTRALMGRLALIGRRCARRRAHAVAMAWAIAKTDYTRQYCKIRYLGKKNSLA

SEQ ID NO: 2160 - protein, 43 aa, synthetic construct
RLKMLRKFLKLFKRHKTDISLFYCPCLHAFRLKIKARTRKGLV

SEQ ID NO: 2161 - protein, 23 aa, synthetic construct
RFRFLCKLYRKLTKTYTYARALA

SEQ ID NO: 2162 - protein, 41 aa, synthetic construct
KFKFFKKYMKLINTLHARHCLKADATFKARGACKRLGGLLR

SEQ ID NO: 2163 - protein, 25 aa, synthetic construct
YLKFFRKFWRILKRDTCRQASLRLA

SEQ ID NO: 2164 - protein, 51 aa, synthetic construct
RIKYFRRYWKLIRCKRALALRIPDAKKAKTCAALSSAQRLKAHKCRARYCF

SEQ ID NO: 2165 - protein, 44 aa, synthetic construct
IYRWLRRLMKLYRHYRKRRIAQPKRLAHAQLRKHANLHAQLLQM

SEQ ID NO: 2166 - protein, 36 aa, synthetic construct
IYRLLRRLIKFMHPKKSDMELFRRTKAMLLALTARK

SEQ ID NO: 2167 - protein, 43 aa, synthetic construct
RFRWLKKYLKYLKHRALLAKKNNNLNELSLYKRAKGFVLKDPY

SEQ ID NO: 2168 - protein, 50 aa, synthetic construct
KFRYFCRFFRRLTTLHKKLDAEALRKKRFRECELLLKALRYKKAAQPAKA

SEQ ID NO: 2169 - protein, 38 aa, synthetic construct
ILKLLKRYFKLLRRKANARRPKCFKVYLFLHLRWPKNT

SEQ ID NO: 2170 - protein, 33 aa, synthetic construct
YFKLIKKLYRFYSRASLRRLRAFPFRALTDAQK

SEQ ID NO: 2171 - protein, 36 aa, synthetic construct
YYKIYKRLIRLLKSWQKRLFATAENKKNRREAADLA

SEQ ID NO: 2172 - protein, 30 aa, synthetic construct
LWKMFRRFLKKLHRMAICLRRVPWAADARR

SEQ ID NO: 2173 - protein, 44 aa, synthetic construct
LLKIWRKFLRKLQKCWRALARATYFLTAYKQKRQPAQMLMCAGA

SEQ ID NO: 2174 - protein, 20 aa, synthetic construct
LFKMLSKLWRRLRQSHWKWL

SEQ ID NO: 2175 - protein, 42 aa, synthetic construct
RLKFMKKMYRKMRRGAIAALRPKPNLYKRANTALDLAAIGHM

SEQ ID NO: 2176 - protein, 62 aa, synthetic construct
FLRLLRRLLRKLRCYQLCKYRCAVKMRLKKMRKWMRRNFLQKAHMGCLMTLAQAHKKARLLV

SEQ ID NO: 2177 - protein, 59 aa, synthetic construct
LLRLLRRLWKFLKNSTRNRLKCTPQNADRLWLLYVALPARDEGLAGKNRDFLFLRYANK

SEQ ID NO: 2178 - protein, 39 aa, synthetic construct
RLKMMSKMWRFWRKGALLFAKVVKAITLACADAVARLKD

SEQ ID NO: 2179 - protein, 22 aa, synthetic construct
FIKILKKLMKLIRRLRLKKAHA

SEQ ID NO: 2180 - protein, 28 aa, synthetic construct
FLRILKKLLRRMKSNVARFHNRLGELAA

SEQ ID NO: 2181 - protein, 28 aa, synthetic construct
RWRLMTRFLKRLNSALPTRKFLALNIRH

SEQ ID NO: 2182 - protein, 44 aa, synthetic construct
RMKMLRKLLKMYSRLRQLGSLPRFSAKVALKRLMLELDSTKGLL

SEQ ID NO: 2183 - protein, 58 aa, synthetic construct
KLRWWKKFLRKLKCPWKWRVTAADKRRCAARCDAACAAAKKKHALAMKTHCHCYWMMP

SEQ ID NO: 2184 - protein, 47 aa, synthetic construct
KIRLFRRLLKWIRNHAFNLCLFLWKKRDRLDTAPAAKLVNLAQRAAT

SEQ ID NO: 2185 - protein, 80 aa, synthetic construct
IYRWMKRIFKKIPKIALLRAYTRCKGSRRAAQWLRRLFATKTAKTCHHTHMRAAPLLKLRQILALNKVHLVKKRRIKLGQ

SEQ ID NO: 2186 - protein, 49 aa, synthetic construct
FLRFMNRLLRRITTDAKKRVKANLTVRKLAACKTKECKKLNAQLWIGRC

SEQ ID NO: 2187 - protein, 28 aa, synthetic construct
LLRLWHRFLRRFRKTIAKAAPVKRCFLL

SEQ ID NO: 2188 - protein, 32 aa, synthetic construct
KFRIIQKLLKLLKKRRSTARTHAETSLIALFL

SEQ ID NO: 2189 - protein, 22 aa, synthetic construct
MMRLLKKLWRLLRHARGKGLHI

SEQ ID NO: 2190 - protein, 27 aa, synthetic construct
LLRMFKRIWKIYPRKARFLKNKCDALA

SEQ ID NO: 2191 - protein, 36 aa, synthetic construct
RWRLWRRYWRLITRNRDRQLMIKRLPCRAAILALEL

SEQ ID NO: 2192 - protein, 36 aa, synthetic construct
LLKLLNKLIKRLCTSLCIRIDLKKALSDEKLRRFPF

SEQ ID NO: 2193 - protein, 87 aa, synthetic construct
KLKMMRKYLRLFTRALRLSAKATDKKALRERRAHLNERKKKGLLVAYNRLANSSLSERVLSRKLAWHDNQRKLLKHLLDIDCHTLSV

SEQ ID NO: 2194 - protein, 22 aa, synthetic construct
RLRIITRLIKRYKRRAAAMYNA

SEQ ID NO: 2195 - protein, 54 aa, synthetic construct
YLKWYRKLLKRLKQIVRLKKAQQLAYRTWKQRGWAEDKVYKLWAWARIALALKQ

SEQ ID NO: 2196 - protein, 46 aa, synthetic construct
RMRFYKRIFRKLRKRDCKLYAFYEALLTLLRYRFLHWERGKLLQWL

SEQ ID NO: 2197 - protein, 28 aa, synthetic construct
YWRLMRKLFKRLQSSLKKYRPKAWATVL

SEQ ID NO: 2198 - protein, 39 aa, synthetic construct
KFKLLPRMWKRLTRKFLWAKLQARIRQEAKKARMSLWAN

SEQ ID NO: 2199 - protein, 41 aa, synthetic construct
FIRLLRKWFRFLKKRGLKAGQRPKKSWAIALLMKKAECRLT

SEQ ID NO: 2200 - protein, 56 aa, synthetic construct
RLRWMRKLIRLMNNRAKAMFRHGRLSAKKVNLRTLTGRSKQLLYMSNMIKRRLLMR

SEQ ID NO: 2201 - protein, 37 aa, synthetic construct
RLRMLRRLFKKLKKFTKGAAKAWLWWKDSHNYARVMA

SEQ ID NO: 2202 - protein, 58 aa, synthetic construct
RIRLMRRLLRRITKKKMLRHKQIRQWTERDWLRGAAYAASTGRAHEARDLPADKALRR

SEQ ID NO: 2203 - protein, 81 aa, synthetic construct
WYRLFKRFLKRIRQRNLTLRLASLRWGALCALKLYAKRRSACLPKTKFKRHKMRKFAEKAERRTIAREFRHAHKKCMGRTL

SEQ ID NO: 2204 - protein, 26 aa, synthetic construct
LLKWIKKLFRFLHHLGYKKEAAIARC

SEQ ID NO: 2205 - protein, 25 aa, synthetic construct
KLKLFKKMMRLWRKLATLEYTMLAD

SEQ ID NO: 2206 - protein, 23 aa, synthetic construct
LLKIFNRLMRKITKAPARIRFLA

SEQ ID NO: 2207 - protein, 37 aa, synthetic construct
KLKLLKRILRKLKRATTAVLNPNFRAKLAHSLSVTIF

SEQ ID NO: 2208 - protein, 24 aa, synthetic construct
KLRLLHRFFKKLPRALGHKAGQQL

SEQ ID NO: 2209 - protein, 39 aa, synthetic construct
LIRILRRLLRKIKQLAGHEKSLVKYALTKRKQKTAATYE

SEQ ID NO: 2210 - protein, 38 aa, synthetic construct
WIRYMQKFLKMWKRLRWAFRRKAKAHRAARLRSASLKA

SEQ ID NO: 2211 - protein, 60 aa, synthetic construct
KMRFFRKFWRKLRNFILRMNFRKADARLYALKASKMRRYPRQMGWILLRLNYYRAAAELL

SEQ ID NO: 2212 - protein, 23 aa, synthetic construct
LIKFLKKWYRLFRKQAHRDLRAA

SEQ ID NO: 2213 - protein, 41 aa, synthetic construct
LWRIFRKLFKMWRRLKWSNWYAHKAALKAKKKPGLDKFLMC

SEQ ID NO: 2214 - protein, 20 aa, synthetic construct
FLRLWHRFLRWFQSKKLRLG

SEQ ID NO: 2215 - protein, 20 aa, synthetic construct
KLRFLRRYIRLIKHAWKCCL

SEQ ID NO: 2216 - protein, 75 aa, synthetic construct
FLKYYKKYFRLIRKNKSIRILDRKKVKRKAAAMRLACMRRNCLMAADYHTKLWGKRKLQHVLKVGALYIKRAKCL

SEQ ID NO: 2217 - protein, 46 aa, synthetic construct
KLRIMNRFLRKLKRRLLASKEYFKRKLANRFAGAQWWVKKGDLKAS

SEQ ID NO: 2218 - protein, 41 aa, synthetic construct
RIKIFRRLLRKMKPRKRERYLAASWARLWGYRLKTELLILW

SEQ ID NO: 2219 - protein, 26 aa, synthetic construct
KLRFLHRFFKRMRCMRKAALDLLECG

SEQ ID NO: 2220 - protein, 24 aa, synthetic construct
RWRFFRKWYRLLRRLFLQLEACRQ

SEQ ID NO: 2221 - protein, 22 aa, synthetic construct
YLKLMQRFMKKMRTQAKAKLNL

SEQ ID NO: 2222 - protein, 78 aa, synthetic construct
KLKWMRRLLRRLCQPAKPTRAAAFLLASRWELKASRLVGFMCRKLQTPFKLKARGIQKDLYRKKSGLRQIMKERRKVG

SEQ ID NO: 2223 - protein, 33 aa, synthetic construct
FFRLMTRWMRRLSSRKMKELKRLKLTLSLNDLA

SEQ ID NO: 2224 - protein, 20 aa, synthetic construct
LFKLMRRLWKRLSRANSGKA

SEQ ID NO: 2225 - protein, 73 aa, synthetic construct
KWKLIKKFWRFFCKHLKKRARERLQLRKTRRMKMVTEKAWRMRTLDAKAAHHYILTAIAEARANEKWLLLPVL

SEQ ID NO: 2226 - protein, 73 aa, synthetic construct
LFKILNRWFRKYRRLATQSHAKMVARVCDKWAHLCIQYATGRLAVRAEAKRLVRRLAGVRGKKGRKRKWLALF

SEQ ID NO: 2227 - protein, 51 aa, synthetic construct
KWRLYHKLWKRLKHLKLYAKKSSVAWTQCCLLWRADLLLGEKMVKLGAPLR

SEQ ID NO: 2228 - protein, 96 aa, synthetic construct
RFRLFPRYFRLMRKMDFALYAAHALQASKRLSHAQKKTCKLKDRAAWRLAALKRVHLRCAYKLDAAQTARRLYLKWPARHFIFKMGRVHRALMSQQ

SEQ ID NO: 2229 - protein, 25 aa, synthetic construct
LLKFLRKMYKRFQRAFWLELTARLL

SEQ ID NO: 2230 - protein, 41 aa, synthetic construct
KFRWLTRLYRLLKPAEDKGALWKWKSNRLAAPDRTRAKNRL

SEQ ID NO: 2231 - protein, 69 aa, synthetic construct
FLRMIRKFLRRFKKVLRKRKTDYAYRKTLAARCCLAHAAEVAARQAYMMKAVPIKAAWGLNLLFARRFD

SEQ ID NO: 2232 - protein, 76 aa, synthetic construct
KIRFFRRFIRLWKRYYHKLRLDQLADARKRLAAANCANYRALAAMVDAHKAQRDDPAKTCRARCANDTGRLEVRRA

SEQ ID NO: 2233 - protein, 21 aa, synthetic construct
MFRLWRRYLKRWKHKAAQQDL

SEQ ID NO: 2234 - protein, 25 aa, synthetic construct
KLRLWHRMLKRLRSLFIRAADSKHL

SEQ ID NO: 2235 - protein, 74 aa, synthetic construct
RYRLFSRYIKRITRRFHCGRANILLKKALRRHIRAMMARKMAAWRAEIALNRKLALTGLMERKVADKTKHKKAP

SEQ ID NO: 2236 - protein, 76 aa, synthetic construct
KLKWFKKMLRKLKQEWLRRRLALASHLKLSCAYARRRPMNLDATAKETYRRLFWYAKVAHWRKDRLFMSMWKAGRI

SEQ ID NO: 2237 - protein, 41 aa, synthetic construct
LMRFFKRFWKIIKTRTVSYRAGKRLAKAKQHARPKRLLAPL

SEQ ID NO: 2238 - protein, 43 aa, synthetic construct
MLKFLPKLFKRFCCKKCILLVIMQKLALKRQYSARAKRTRAQH

SEQ ID NO: 2239 - protein, 86 aa, synthetic construct
RIKLLCKMWKKMKKQYAKYLSEMKAKSLPMRLRRLKKKPLKKYALKYAALFVRGHAAALRKPMACISQFCVLSKTDHQLKRLWAIR

SEQ ID NO: 2240 - protein, 46 aa, synthetic construct
KLRLFRKFIRKFKTALYKIWKARTKRTLKNWLALRVYYLAVMLRSH

SEQ ID NO: 2241 - protein, 34 aa, synthetic construct
FLRLLPKWLRKWQKTCAKFEAGRKAALANNPLSE

SEQ ID NO: 2242 - protein, 29 aa, synthetic construct
IWRIWRRLLRLLKCGALKWALHVNKAKSY

SEQ ID NO: 2243 - protein, 54 aa, synthetic construct
RLRFFQRMMRRLQCASNAVLMKPRLARKAESIRLLKRADVKACKRMLLEHYTKE

SEQ ID NO: 2244 - protein, 77 aa, synthetic construct
RYKMMPKFFKKLNSAAIVALKACDMRDAQRGLHYAILQKFNREHLHKARCLRRALIRRKHARKATAAHPYLKKAKLY

SEQ ID NO: 2245 - protein, 31 aa, synthetic construct
RLRFFHRLMKKLKTSAARTRRETKANPIAYL

SEQ ID NO: 2246 - protein, 45 aa, synthetic construct
YLRILKRFYKYYRQLVLLPRRHRALRAKIIAGAQMAANRHAEHAA

SEQ ID NO: 2247 - protein, 25 aa, synthetic construct
LFRFFRRLLRRLCQIWAQNKGRKLI

SEQ ID NO: 2248 - protein, 21 aa, synthetic construct
LFKLLQKMLRYWRKACTLHKR

SEQ ID NO: 2249 - protein, 46 aa, synthetic construct
RIRFMKRLFKIMHRARACPAAWRTVLDRRRTLTWNLVKKRALARAM

SEQ ID NO: 2250 - protein, 34 aa, synthetic construct
MWKYMRRWYKKLHHAASLRWLDAFLKWMKAKRLA

SEQ ID NO: 2251 - protein, 24 aa, synthetic construct
RIKLLRRWLKRLSSRLHKGVPAEA

SEQ ID NO: 2252 - protein, 32 aa, synthetic construct
LMKFYSKWWKMLKTALAARAKRRPKDARKWAQ

SEQ ID NO: 2253 - protein, 20 aa, synthetic construct
LWRLLHKIFKRYKRGILVKL

SEQ ID NO: 2254 - protein, 21 aa, synthetic construct
KYKYMPKLMRLINKKLSRACA

SEQ ID NO: 2255 - protein, 50 aa, synthetic construct
KLKYMRRIMKKLRCAATFVLLHKRLYLRKALTAAPKLAHAQLRRPKANDY

SEQ ID NO: 2256 - protein, 63 aa, synthetic construct
LIRLMRKMLKKLKQTKCAKSVIRAEHCPLYYLKNKLQRRAMANACKKLRWKRGQVTIELRAEA

SEQ ID NO: 2257 - protein, 70 aa, synthetic construct
FFRLLSRWFKRLRRANIQLELKLAARKLHKYDHKEAQMAQAKLHHNQMMRKLKGVKGNKRAKKRLPFETR

SEQ ID NO: 2258 - protein, 52 aa, synthetic construct
YLRLFRRFLRKIRPLRGRGHKYQVNKLRRPARAIIWTGIFVKLKALFVKALA

SEQ ID NO: 2259 - protein, 45 aa, synthetic construct
FWRFLRKFFKLYRSVDAHRLSRKRRFVHKKRKLNQALPAFEAAVA

SEQ ID NO: 2260 - protein, 33 aa, synthetic construct
KMKLFKRFMRKIKRDGFSWLMAARARPAQAVLA

SEQ ID NO: 2261 - protein, 39 aa, synthetic construct
KFKMLKKMFRKFKRLRVYMLVLEKKYLLELADLTLKMAL

SEQ ID NO: 2262 - protein, 64 aa, synthetic construct
KFRFWCRLFKKYRHRKMLEQKLEARKMRVLAKAVTKIRYMAKRLGLKHMACLRDHLLNLDYKAR

SEQ ID NO: 2263 - protein, 58 aa, synthetic construct
YLKIFKKILKLLPKRAPAKSKRKVKKLALFALKLCWRQPPVMLGNVCAESRHRRLLYM

SEQ ID NO: 2264 - protein, 29 aa, synthetic construct
KFKLFTKILRRIKQLPAARMVELLKAKLR

SEQ ID NO: 2265 - protein, 63 aa, synthetic construct
LIKMYQKFYRKMKRLTALSKLNLLQLNARLAPSALNMIMARKAIAEVRLNKICNDVRKAAAFR

SEQ ID NO: 2266 - protein, 67 aa, synthetic construct
RLKWFCKLYKRWKKKWGPLPMLLLRYKHLAKSLLIRFLALKFYADSTTMADLDRKRLCKKYGKPWLM

SEQ ID NO: 2267 - protein, 99 aa, synthetic construct
RLRYLRKLIKLLCTMKSWLKVNLYMYKLANWRAAANFANLQTYWKKKPECLGFAKLRKKTALFTKLKAKWKYAVKKVLQLRLWLLLKAMLFHCQNAVFC

SEQ ID NO: 2268 - protein, 41 aa, synthetic construct
FLRLYNKMFRLWKKAGKKHRARVKCHCRKPLSRACILTLCL

SEQ ID NO: 2269 - protein, 40 aa, synthetic construct
KYRWLKRLLKLFCKKAWLLCARKQDLARGTRLRAFAFYMK

SEQ ID NO: 2270 - protein, 20 aa, synthetic construct
FLRLLRRFMRLFTKANCKAK

SEQ ID NO: 2271 - protein, 58 aa, synthetic construct
LMKLLKRLIRRLTHTAWKAMGKKIYLKLDSSNLRRKAARKMAMSVVKIKKNLKWMRNH

SEQ ID NO: 2272 - protein, 32 aa, synthetic construct
LYRLLRRWIRRYSRAFLKTLEDRLAYMRWTAF

SEQ ID NO: 2273 - protein, 44 aa, synthetic construct
KLKMIRRMMRWLTRLPRLAFLLGIRLKIISGGRAVELRDLLRTA

SEQ ID NO: 2274 - protein, 34 aa, synthetic construct
KFRLWKRLWRLLKRRLNTLWQPLVLTTCYFMKLA

SEQ ID NO: 2275 - protein, 68 aa, synthetic construct
FLRMINRIMRLLRKAKLAPRLLIECAREPQKVTKLCATLLKLAHAALFFEWCHAQETAHRDKLKKSLK

SEQ ID NO: 2276 - protein, 52 aa, synthetic construct
RIRWLPRLLKWLCNLDRKLAPAQKLKFTAPATAGDRCRARNEKPATPKHLLF

SEQ ID NO: 2277 - protein, 75 aa, synthetic construct
KFRWYNKIFKRWKKCKRRKRTAPAGAALLAKKAIKADKWAKITDTAKAAALANAAGKDKLNGSALALKMAAKNFY

SEQ ID NO: 2278 - protein, 74 aa, synthetic construct
RYKYYKKLFKRMRSHRADLRMCRIEKCWRLRLAAALLRKRSLGLVCLSARERTRKGTKRASLRDAMIYKALSGG

SEQ ID NO: 2279 - protein, 37 aa, synthetic construct
RLKLIKRLFKLIHHVLVQCKLIAILAANLQKKEWRWL

SEQ ID NO: 2280 - protein, 45 aa, synthetic construct
FYRLYCKLLRWLKKMKAKPRDWPATHRYLARRCAATLGRVVTKLD

SEQ ID NO: 2281 - protein, 38 aa, synthetic construct
RLKLFKKWWKLINSLYPRLDLNKNFALHYKTLLCKALH

SEQ ID NO: 2282 - protein, 98 aa, synthetic construct
WFRLWHKILKLLRRYELFKRKRRNCMILYNKIAMLNFARRARLFAWVKLLFRKDPAAPIAACGMAPCLLAHCAFLKLRLIFLHLRKFMVKKYKLKKQK

SEQ ID NO: 2283 - protein, 75 aa, synthetic construct
KFRLIKKLFRKMKKLAINIRKAARAPLEFKGYALAWLVLRELYGLGNALPPKRTTCARRDQELILHAVAKLWDDL

SEQ ID NO: 2284 - protein, 26 aa, synthetic construct
KLRIFKRLWRLLKKRTALADNMLMFK

SEQ ID NO: 2285 - protein, 52 aa, synthetic construct
KLRMFPRIYRIIHPKVRIRLSAPLLERARCSAPLKANVASLKDYRKWAKKLK

SEQ ID NO: 2286 - protein, 29 aa, synthetic construct
RIRLIQRLFRIMKNRSTLPKRPAAAASKQ

SEQ ID NO: 2287 - protein, 87 aa, synthetic construct
LLRFMRKMLRRLRSATRKVLGHALRRCNMCRSAAELQPQKLIARRKLRRLCRWRALVRKCAMGDAEAERKDYHPKALKLKREYKDGR

SEQ ID NO: 2288 - protein, 38 aa, synthetic construct
FLRMLKKLLKKIKRPCAHLWLHRNILWQRNTLAQQTAL

SEQ ID NO: 2289 - protein, 30 aa, synthetic construct
LFRWFNKLLRRWRRHTKLAQKSLLSTKELM

SEQ ID NO: 2290 - protein, 43 aa, synthetic construct
MMKLYCRYLKYYPRAIPLRKKDWASAKTLNKNQKLLSRKRDAK

SEQ ID NO: 2291 - protein, 29 aa, synthetic construct
KLKMIKRWFRLLHSFVKARAKLCTMHRAC

SEQ ID NO: 2292 - protein, 98 aa, synthetic construct
KLKYFKKFIRLYRKSEMHSRAKGGAKVAARKGMAWRASNEAPCLWKLCCALKRNRRKWIYKMFRFRGDAARVRRAKRKYGARRKLEDLVAGLKLELEM

SEQ ID NO: 2293 - protein, 44 aa, synthetic construct
KMRWLHRYWKLLKKDRDCKGALLLKWRYYNLHYQLRCYAKLKPK

SEQ ID NO: 2294 - protein, 53 aa, synthetic construct
RFRWWKRLFRFLKCAQVSRAEKGLVKQWLLKALKPRNRAKVARALIAVVFLKN

SEQ ID NO: 2295 - protein, 32 aa, synthetic construct
LFRWLSRLFRFFHTYARRKSWTARAKWRLKLH

SEQ ID NO: 2296 - protein, 39 aa, synthetic construct
RIKLLCRLLRRMKKEDLDPGMAQRRSKQAKLVRLILMYG

SEQ ID NO: 2297 - protein, 87 aa, synthetic construct
IWRYLKKLFKKIKKGHPASVMCDSKRLLLRARRIKDFHAKKKCKASDYNLAAKAAAKRHHKKTQRARRMCAWQMPVVKMAEAKYILR

SEQ ID NO: 2298 - protein, 41 aa, synthetic construct
LFKILSRLYRLLRKQRFLQLKASARLKRYHRTSLNTLKELF

SEQ ID NO: 2299 - protein, 69 aa, synthetic construct
KMRLIKKLFKYLKPDRAGGSKINKKLVKKLSMLKLRLNKCDRKMAMAPMRARGCAATGAWLKTMETSKK

SEQ ID NO: 2300 - protein, 33 aa, synthetic construct
YLKLFKKLLKFFRRQAPKLPEAYPYACRQELLA

SEQ ID NO: 2301 - protein, 27 aa, synthetic construct
RMRLMCKWLKWLQKRHTLALERRRAKL

SEQ ID NO: 2302 - protein, 49 aa, synthetic construct
KFKMFRKYLRKFKKRDYKCRAAMACTKRLHLSATAYLRDVIMMAAKLWK

SEQ ID NO: 2303 - protein, 58 aa, synthetic construct
KIRLLKRLWRKLRSIKKRPQAKYPKAALKDDIAIDELRALKRSHPLCVERKGNGHLHG

SEQ ID NO: 2304 - protein, 43 aa, synthetic construct
KLRIFRRLLRRLRQKALKQLRLDDAVADRAGHAKRKIHKAMRV

SEQ ID NO: 2305 - protein, 26 aa, synthetic construct
RLRMFRRLIKRFRSPAESLLFEQLAA

SEQ ID NO: 2306 - protein, 26 aa, synthetic construct
LIKLIRRLMRLWKKAAYLQINNVRDR

SEQ ID NO: 2307 - protein, 33 aa, synthetic construct
FLRLYKRLLKMMKPTKSSVLARCALCKANGLDA

SEQ ID NO: 2308 - protein, 32 aa, synthetic construct
RLRFYQKMLKWLQRFVKMPASAAKMRVKMLKA

SEQ ID NO: 2309 - protein, 41 aa, synthetic construct
KLKFFPRILRFFSRKKYRLYRRGLEADSSALKARARLIFNV

SEQ ID NO: 2310 - protein, 21 aa, synthetic construct
KLRFFTKLLKWFKQACLKIRV

SEQ ID NO: 2311 - protein, 23 aa, synthetic construct
RLKWMTRWIKLLNRKLNGQKLLE

SEQ ID NO: 2312 - protein, 20 aa, synthetic construct
KIRLWCRLWRLLKNQLGLRL

SEQ ID NO: 2313 - protein, 48 aa, synthetic construct
LMKMFCRLLRYYNKKDTLQAGCAARANWFRKLLAPSYRALARNRLQAK

SEQ ID NO: 2314 - protein, 33 aa, synthetic construct
FIKLLRKLIKKWRKHEAKFRMRGWAAALKGPHL

SEQ ID NO: 2315 - protein, 49 aa, synthetic construct
KWRFWKRMIKYFKKALAFVEARRQGFATSAKLRKKLARAVLNVATKNAR

SEQ ID NO: 2316 - protein, 72 aa, synthetic construct
KLKIYRRLLRYLRSHFRKFKLAGHCWPAERVARKARYKLDTQAWLKNTKGKRLMLAGLRLKCCILRDDHNRH

SEQ ID NO: 2317 - protein, 29 aa, synthetic construct
FYKLLKKWLKILRTKWKTCALDQKKKALD

SEQ ID NO: 2318 - protein, 66 aa, synthetic construct
FFKLMTRLWKWLKRTKAKQARASKAKHDLYLRQMQAKREVKYALRIYKTSKAAYMVSAKNLLKLYA

SEQ ID NO: 2319 - protein, 55 aa, synthetic construct
RYRLFRKYLRLLKRLYYNDRMFLKKAVKAWKWVALVLAFPARCQRAQRDFGLMRK

SEQ ID NO: 2320 - protein, 31 aa, synthetic construct
RLRLFTRLFRKFHNARDLIAAKAKSLKLEVL

SEQ ID NO: 2321 - protein, 69 aa, synthetic construct
KFKLYNKFLRLFRRLSLFHARDRAARRARDATRLNGHAKPLNKKANWTKTVTLNWCAVQYKRLKRLLPW

SEQ ID NO: 2322 - protein, 50 aa, synthetic construct
LLKLLQRWFKRWTRDIRRHCRANKERELRLRRLIFHMLALLILAAAFHAR

SEQ ID NO: 2323 - protein, 74 aa, synthetic construct
IFKFIPRLMRLMKKVLFRFRPLYANAVRARNMKAVLLRKAALSKRALNIMDWRSKLRKEKLLLIMYQGFRRAKG

SEQ ID NO: 2324 - protein, 30 aa, synthetic construct
LWRLWKKWFRRFHTKLAKLLKFKRGHRAAT

SEQ ID NO: 2325 - protein, 37 aa, synthetic construct
ILRFLQRLLKFFTKKRKVARLGEMNKREFLAFMSLAK

SEQ ID NO: 2326 - protein, 38 aa, synthetic construct
RYKLLKRIMRLIKRKQKAGQLKIGRLAAGANDLHHYDW

SEQ ID NO: 2327 - protein, 40 aa, synthetic construct
FLKFIKKFWRKLNKKKKIPTPSLLNKLSLSRLWASASRYA

SEQ ID NO: 2328 - protein, 35 aa, synthetic construct
RMRLMTKWLKKIQRKHLLLRASAKINNMLFQAARQ

SEQ ID NO: 2329 - protein, 34 aa, synthetic construct
FLRLFRKLLKMLKPGHKSQSTVARRLALADKAQY

SEQ ID NO: 2330 - protein, 30 aa, synthetic construct
KMRFLKKYFKWICKMLHAKANLKAMVTKKA

SEQ ID NO: 2331 - protein, 21 aa, synthetic construct
LLKFLCRMLRRYKKHKALMTH

SEQ ID NO: 2332 - protein, 32 aa, synthetic construct
RFRLYRRLLRRIHQSLPARAKHRATLVRNARL

SEQ ID NO: 2333 - protein, 49 aa, synthetic construct
LLRIMPRWYKRLKKRYSKATALRRWLCGAAMRLRAQRMAKEWHETIMRL

SEQ ID NO: 2334 - protein, 76 aa, synthetic construct
RYKLLSKIWKKMNTQASLPLQKRRRAKHALAARGAKLHPFLREAKLTYLIPLDAKAKYKVASGWLNQARVMWAYRR

SEQ ID NO: 2335 - protein, 43 aa, synthetic construct
LIKMLKRYLKLLRRGGACRATPAARLSKKRGYMQRVLSTRRQC

SEQ ID NO: 2336 - protein, 29 aa, synthetic construct
KLKFYKRMFKFFKKAIHSLLAKLSRAGKA

SEQ ID NO: 2337 - protein, 50 aa, synthetic construct
KFKYYCKIFKYFPRHLKVAKDKKIKLRILLERWRALLKVKWVHSHLALKL

SEQ ID NO: 2338 - protein, 41 aa, synthetic construct
RLKLMRKMMKFYRRLLHDTLAKNAAMFRAILQRPVNKLASC

SEQ ID NO: 2339 - protein, 80 aa, synthetic construct
RYRLMRKLLKILRRLALAPRHPDNCFHCKKQRQLPRSKKKWAKPRQFNCENYRAKLPARVLFARKSRGSDARMTYLHALL

SEQ ID NO: 2340 - protein, 76 aa, synthetic construct
RFKMLRRFYKKFKKKAKWPLKLHGQKLTLLTARGLLRKRYKLLAKNKTNPWTSLAHALRRKGAQHKGEHLAKDLAN

SEQ ID NO: 2341 - protein, 25 aa, synthetic construct
YYKMWRRFIRRLRKAFKNALNLPAY

SEQ ID NO: 2342 - protein, 30 aa, synthetic construct
RLKILRKFLKMFRSALTNMKYAGCYKIRAR

SEQ ID NO: 2343 - protein, 40 aa, synthetic construct
KYKYLQKFLRKMRCMSIDREKPLLTAFIKRLSAALGARAD

SEQ ID NO: 2344 - protein, 42 aa, synthetic construct
MLRLLKRYLKLFCTIRNHRPLWRLKQKKKLAKAVCDKLQPTY

SEQ ID NO: 2345 - protein, 28 aa, synthetic construct
LWRLFRKLMKRYCKWEKVKWLNPLTKLA

SEQ ID NO: 2346 - protein, 84 aa, synthetic construct
RFKFMKKMLRRLCRLVMSRAQKAMVAKCFGRKLCLAQPTLGRRSTLKLIKKKHICLLRLKAWKKLVKLYLQKSLWYQKTRIFKT

SEQ ID NO: 2347 - protein, 75 aa, synthetic construct
YIRLFRRFLRLFRQTRLCAYRALLTGAALKRWMAALCRQKRRPRAMTAHKQKYKTLRLELSRMCRDRHAKVYTDH

SEQ ID NO: 2348 - protein, 38 aa, synthetic construct
IFRLLRKFYKKLKKKERIPHLRYELLASKAWLMLLLKC

SEQ ID NO: 2349 - protein, 41 aa, synthetic construct
KFKLFKRYLRKFRKRAALLNHARVPKACLNHYEAKEKFVEA

SEQ ID NO: 2350 - protein, 70 aa, synthetic construct
FLRLYKKILRKLCTQAMKRPINWLISSLNLKTKKVRRRRSARPWLKEKARAFQWIWWLRLRHLRMRAINR

SEQ ID NO: 2351 - protein, 73 aa, synthetic construct
LYRYFNKLIKIMPKRRKLVWLLKKRKRKRGRLLVSVLPPHMLARLEKYQDLHKKDWLALLFRKAFGKYRCQWL

SEQ ID NO: 2352 - protein, 37 aa, synthetic construct
WYRFMRKILKLLSNLLVKFNLAKKAAKFYKLKQRREP

SEQ ID NO: 2353 - protein, 63 aa, synthetic construct
WLKFFSKFYRKWNKLKEQFKKRAYAETLLAFALRRKAQALGLRRELQFNQDRILGEKARKLAV

SEQ ID NO: 2354 - protein, 27 aa, synthetic construct
RFKFLRKLMKYIPKAIALKKFLFKKLL

SEQ ID NO: 2355 - protein, 74 aa, synthetic construct
RFRLWSRMFRILKRHLRLRYKYKERKIRYGFRYTLKPLWFATLAWDLKANRAQIAHKLCISQRSLNLKALRRKA

SEQ ID NO: 2356 - protein, 70 aa, synthetic construct
KLRYWRKWFRRFPNMAAPKRAKLAILGRRKRWKNPGKASTLRLLTIPHQLEINKVRLKIKYKLKALAQRK

SEQ ID NO: 2357 - protein, 48 aa, synthetic construct
FFRLWKKIFRWLPKARMAPHAFFLAGRARDKIYLLARYLCLRRKSTAG

SEQ ID NO: 2358 - protein, 35 aa, synthetic construct
ILKILKKLMRKLHQAWHWALRRRTGKAHADRMEPK

SEQ ID NO: 2359 - protein, 44 aa, synthetic construct
WLRYWNKYFKRLRPCCDLAADLKERCLGMRDPKRLFAKLLKHLR

SEQ ID NO: 2360 - protein, 43 aa, synthetic construct
ILRFLRRLMRLFTRSALEMRNRLCGRARRLGYWSILLHPYKAL

SEQ ID NO: 2361 - protein, 40 aa, synthetic construct
RLKLYNKFLKLWKRMGLPRHNKVRDCTTALKDKWKLCSLK

SEQ ID NO: 2362 - protein, 35 aa, synthetic construct
RMKLWKRWMKLLKPQKLSILKIKKAAKLARQLNRE

SEQ ID NO: 2363 - protein, 21 aa, synthetic construct
YMKILRKLLKRFKRMSAQMAT

SEQ ID NO: 2364 - protein, 53 aa, synthetic construct
RIRFFPRMFKLIRKKNLRLYRLKQILALNLANVADDWKKAQHAKLGSKLLSRN

SEQ ID NO: 2365 - protein, 99 aa, synthetic construct
RFKYYRRLLKLIKKGARCCRLPRLRKLNLMAREGCLDMYRGLNSIAILAAPWARLFLRQRRSQRWDLKRNLEKASVAPRARERRMVCKLYIFQLALLRF

SEQ ID NO: 2366 - protein, 44 aa, synthetic construct
FLRLYSRWFKLLRCAAAKARRQIKKRIHRLYACDALCNVKSIRN

SEQ ID NO: 2367 - protein, 30 aa, synthetic construct
RFRLLRRMWRFFRNHLAALLERIRMKLLWA

SEQ ID NO: 2368 - protein, 75 aa, synthetic construct
RLKFLTRWIRRFKRHLVIAAAAWAAHQGRRNVKPMLRLRSRFFAGLRKFARIDADLRRSKKALRGDRAAATLGIK

SEQ ID NO: 2369 - protein, 26 aa, synthetic construct
RFRLMTRFFRKIKSALKRGSKTALLA

SEQ ID NO: 2370 - protein, 38 aa, synthetic construct
FLKLFSKMYRKIKRGLKRLAKQLAPEKSWENIWTLLLK

SEQ ID NO: 2371 - protein, 22 aa, synthetic construct
LYKLLNRIWRKLRRAIDLAAAK

SEQ ID NO: 2372 - protein, 20 aa, synthetic construct
WLRYLRKWLKYLQKEANRFH

SEQ ID NO: 2373 - protein, 54 aa, synthetic construct
RMKFFQKMYKWFKQLAARAHLVRDLRALELLYQALNLIQKWGHSRKKIKALLLF

SEQ ID NO: 2374 - protein, 39 aa, synthetic construct
WLRLLRRIMKRLRSSLMGARRHWASRLRALLCKAVKRVS

SEQ ID NO: 2375 - protein, 86 aa, synthetic construct
LLKLFKRLFKKYRRRRARHRYNPVNKAQMSVVRKLERSLYSARRSGALAWKLKKMRWLAKDKELQCHAFLRRLLQNCQSSLRTATR

SEQ ID NO: 2376 - protein, 75 aa, synthetic construct
RWRLIKKFYRKLRKNYLRLKNIRQYKSREPRMWKRPLLRKLCYGLGRLAALAEWKLNTMSKQNAYTTLLQMAAAL

SEQ ID NO: 2377 - protein, 29 aa, synthetic construct
KLKIMRRMLRYIKRMVQLKALALACYSQK

SEQ ID NO: 2378 - protein, 21 aa, synthetic construct
WWKIIRRILKRLKPALLDLHP

SEQ ID NO: 2379 - protein, 28 aa, synthetic construct
ILRWLRKLMKRIQHRAIRCYLAKEKAYM

SEQ ID NO: 2380 - protein, 94 aa, synthetic construct
LLRLYRRMFRKFRKRRKRFAPAKLALKAMIGAKCGYKKRNNIAASRKALRRRNKLFLLKGLLMKRQIAKKLKNNHIRCQLAWAVGRGMMYANFA

SEQ ID NO: 2381 - protein, 87 aa, synthetic construct
FFKWMKRILRRLNKAPTAAHSLRIRAFNEVRLRRRAKKKGHYVRLNLWRAFPVHAVRAWFLLQRWASYTPRASLADKFRAKKLMRPR

SEQ ID NO: 2382 - protein, 50 aa, synthetic construct
KLRFYRRILRKYRRAREKLFTAWQERPKRKIELTLCRLCLELRARTALAS

SEQ ID NO: 2383 - protein, 58 aa, synthetic construct
MYRFIKKFLRFIRPRLRCERMHKFMRRCARAAKFAYKGLARLPLMTRGKLQLLPARWL

SEQ ID NO: 2384 - protein, 23 aa, synthetic construct
KFRLLKKYFKRFRRCSWAPFALL

SEQ ID NO: 2385 - protein, 78 aa, synthetic construct
LFKLWHRWLRRMRKIQALLFRNDKAADCKTRLSGMSQRFLLLMANRTTARKSKFEKAVRKTLLIADRLRSAKQEDQRK

SEQ ID NO: 2386 - protein, 28 aa, synthetic construct
KLKLFNKYWKKMRKHLQALVAHLTRKAM

SEQ ID NO: 2387 - protein, 20 aa, synthetic construct
LIRFFKKFYKRLKTASQLDL

SEQ ID NO: 2388 - protein, 31 aa, synthetic construct
KYKWWKRLLRRLHRCMRLQKYFAKYFRALAA

SEQ ID NO: 2389 - protein, 62 aa, synthetic construct
KFKLLKRLIRRLPKAKEAMPEAPDRALRASDRAEDKAMMHRCCKGPRARKRMRAKAHFLMQK

SEQ ID NO: 2390 - protein, 52 aa, synthetic construct
LLRMLRRLWKWWKKIVQLALHKNIKRTLCRFDDKKHSMCKLLHCELHRRKKL

SEQ ID NO: 2391 - protein, 50 aa, synthetic construct
FYRFMRRMMRFMSKRLRCTRVNARKFELDNSKALAARKAATFAWLLALPL

SEQ ID NO: 2392 - protein, 58 aa, synthetic construct
RFRIIRKMYRRLRKKRALALLRAAMIQAKHSDWLAKLARCCRRWLAPKILGRVKTHPL

SEQ ID NO: 2393 - protein, 55 aa, synthetic construct
KFKMYRKFFKLIKSKRRDALNIARRHAMDFKAFGHLRALIKARAAWKDPEKHLLY

SEQ ID NO: 2394 - protein, 34 aa, synthetic construct
FFRLWKKFLKKICKTAARFNRAAALRSKARAAYL

SEQ ID NO: 2395 - protein, 33 aa, synthetic construct
LLRLLTRWFRWFKKAQAKHCGQLRHALKTLHPA

SEQ ID NO: 2396 - protein, 54 aa, synthetic construct
KFRFLNRLFRKFKNKCLMRAEIRIPKCVAKSPNRWLLLKLLAWDAHQVARAALR

SEQ ID NO: 2397 - protein, 23 aa, synthetic construct
LMKLFQKFLRKLKHCLHLVKFAH

SEQ ID NO: 2398 - protein, 29 aa, synthetic construct
KFRLFHRILRKFPPWCASAVALKGKLART

SEQ ID NO: 2399 - protein, 37 aa, synthetic construct
MFRLLRRLWRRLRKEARVGLQRLAYRYIKAAAKRAHL

SEQ ID NO: 2400 - protein, 82 aa, synthetic construct
LFKWLKRLWKFMRRAKGNKDALKAKRRPAALKKRNATEGGSAEKTGEALRTKFMSMTSYKAALRYKWRQEAKKRDFRRMMAA

SEQ ID NO: 2401 - protein, 31 aa, synthetic construct
KFKFIKKILKWLRKSWLPRARAKPGALKCLA

SEQ ID NO: 2402 - protein, 38 aa, synthetic construct
KLKMYKKFLRRFRRFLATTLRGQRLLEEWHWQAADSKK

SEQ ID NO: 2403 - protein, 39 aa, synthetic construct
LMRLLKRWIRRWKNLRAGAARMWWFTGGAKKAAYKAKFS

SEQ ID NO: 2404 - protein, 37 aa, synthetic construct
LLKILKRLWKRFCKRMKKVAALGNAYKNGGELFARDQ

SEQ ID NO: 2405 - protein, 20 aa, synthetic construct
KLKLMHKWIRLLSKMVADKH

SEQ ID NO: 2406 - protein, 25 aa, synthetic construct
RYKLMNKLIRLIKRPLAKFRAENAI

SEQ ID NO: 2407 - protein, 41 aa, synthetic construct
FLRFYKKFFRKLSRNPAARAVRNCAIKKKTVARYRCLNLLA

SEQ ID NO: 2408 - protein, 38 aa, synthetic construct
LFRLMRKLYRKFNRYSLLLEKRRPLAPSARDKTMRFAV

SEQ ID NO: 2409 - protein, 30 aa, synthetic construct
LLRIFKRLLRKLRHWLKMLNHPMRLPHAKK

SEQ ID NO: 2410 - protein, 51 aa, synthetic construct
KWKLYKKYYRRMKKLRANQSKLSRQELFLQNCAAKHTCKILLLKLKKLCLP

SEQ ID NO: 2411 - protein, 36 aa, synthetic construct
RYKLWRRYFRRLCTLMCKRADQLQKAGLWPRQLLLD

SEQ ID NO: 2412 - protein, 68 aa, synthetic construct
RLKLLSRILKFFSKNIFHGRTLALALATKKLERAKATPKLRKRRRFGAKRVWDKRNMWTIKPLRSNKL

SEQ ID NO: 2413 - protein, 25 aa, synthetic construct
LLKFLRKFLKLWRRKTLDMTIHSER

SEQ ID NO: 2414 - protein, 37 aa, synthetic construct
KLKWIKKYLRRMRNVIARPLRVLKLCDQAKRALLKMQ

SEQ ID NO: 2415 - protein, 39 aa, synthetic construct
FMRLMRRMLRMWTTLLWLRWGLKALRFYTKRAKLAKHFA

SEQ ID NO: 2416 - protein, 25 aa, synthetic construct
RFRLFKRWMRKMHCHAKKSLLDPAA

SEQ ID NO: 2417 - protein, 40 aa, synthetic construct
YLRIFRKILKLYCCLKQKKKQWRCAADLKMRVSALTPLPR

SEQ ID NO: 2418 - protein, 90 aa, synthetic construct
KIRYLKKMMRLLRRQKHKLKDKCNLLKVAHTDKLMTLAFYKKAMTKCRAAAMALFTCKGFAYLAKQRNPTAELARDKVLHYLARWGLKRQ

SEQ ID NO: 2419 - protein, 38 aa, synthetic construct
LWRWWKRFIRLFKREHRVLLLVPRKYWLLAARLNACRM

SEQ ID NO: 2420 - protein, 31 aa, synthetic construct
KWRILTRLFRMYKKRKRTVNHYALLYLRLAL

SEQ ID NO: 2421 - protein, 54 aa, synthetic construct
RFKWFKRMWRRIKRLRTTLFPFRLLTIRKAELRARRDAALDVALNTLLALWHRV

SEQ ID NO: 2422 - protein, 25 aa, synthetic construct
LWKMIHKWFRKLKCLCALNLLSKGR

SEQ ID NO: 2423 - protein, 40 aa, synthetic construct
KIKLFSRIFRFMKQLAEYAKKAMQMARAWFKNKHRAAYAL

SEQ ID NO: 2424 - protein, 24 aa, synthetic construct
KLRLIRKLLKMYSSKNKHPWLLPL

SEQ ID NO: 2425 - protein, 54 aa, synthetic construct
LLRFLSKFLRIFKRVLLGRRPQLAGKRFKFKRYTLKKHDLQRWASHKNYIADAL

SEQ ID NO: 2426 - protein, 29 aa, synthetic construct
RFRMFTRLWKKWTQKGARKLKLAWAGLPQ

SEQ ID NO: 2427 - protein, 61 aa, synthetic construct
RYKMLNRWFKFFTRAACAAPNLKIPKCDKALYLYRRKCRARDKFNALVLMTRNLKKAAKRH

SEQ ID NO: 2428 - protein, 74 aa, synthetic construct
RWKFLKKLMRRIKSRLRTKNQAASVLPARERREAIEFRAELKLRTKLRQPAKGLLLRCNLRYRTKRFQLAGRKL

SEQ ID NO: 2429 - protein, 41 aa, synthetic construct
LLKWLHKLFKRLRRMATAHLWGLKRLSQRIKEGKMAKMAEL

SEQ ID NO: 2430 - protein, 45 aa, synthetic construct
RIKMLRRMLKKWKRPEDYLKWMLAALACDALSMRQAATYLLRARG

SEQ ID NO: 2431 - protein, 60 aa, synthetic construct
MLKLIKRLLKRFKRRKQKAAQALEKWSPRPALDTYYLMKLANDRAYAKDRKQRLTRDRAK

SEQ ID NO: 2432 - protein, 30 aa, synthetic construct
YWKLFPRWYKKLKRCAKLRLTRKAKLDLLC

SEQ ID NO: 2433 - protein, 64 aa, synthetic construct
WWRLFKRLLKRLTRVLLRYTRKKANRRLPWLLKMEISEAKKNHRLAGKKLQVANDRKERARADA

SEQ ID NO: 2434 - protein, 20 aa, synthetic construct
RMKFFKKFLKKLKNLDPMLA

SEQ ID NO: 2435 - protein, 34 aa, synthetic construct
RFRFMNRLLKRFQKRWLLKFLPAMKPKLGLARLL

SEQ ID NO: 2436 - protein, 69 aa, synthetic construct
FWRWLCRLLRRLRRHNDRVHLSRTDKALMLQKLDEREAQTRWMVLKGAMRRSNSKLKGIYCRALAKKLR

SEQ ID NO: 2437 - protein, 94 aa, synthetic construct
RFRIIRKFLRRIHSVTLIKKMLQIWHAGFARRLLKLLAVLFGTEKLLAKKTAKMFKKEMWRRKKIRTLLAKRGDMAKQLLAWREGRLMKKRKWR

SEQ ID NO: 2438 - protein, 58 aa, synthetic construct
ILKLLQKWWRFWTSASKPKMALLRKTDAFTGLLALDTRHGSLRKVAKPKAMRKLPAEK

SEQ ID NO: 2439 - protein, 72 aa, synthetic construct
KLKYWKRFLRKLTSMQYLRDRFQKAQRRKLPHATEKKCAHQLLRCTNYDRYFRLRPRDALRCDLKALKPKLI

SEQ ID NO: 2440 - protein, 26 aa, synthetic construct
KLRLLHKWLKFMRKCRLSTQMGRALR

SEQ ID NO: 2441 - protein, 47 aa, synthetic construct
RFKFISRWLKKLKQRCKARKLGATLGYLNYRIHRRLKVAMLHTRFAF

SEQ ID NO: 2442 - protein, 28 aa, synthetic construct
KMRFFQRMYRKIRKALILHLTKARMALT

SEQ ID NO: 2443 - protein, 56 aa, synthetic construct
LMKYFRRLWRRMRTAKLWLLKRNLYRLPRKWAARHQLGGRRRPSRNLCAYYCTLFR

SEQ ID NO: 2444 - protein, 85 aa, synthetic construct
RLKFFRRLFRFFKPALCAKATVFMKLRLCLLNPARAMRWPAKKLRIVRTLKVDFERAGYSSKRKPERNCIRARAAKGNKLIARYF

SEQ ID NO: 2445 - protein, 48 aa, synthetic construct
RLRFLCKFFRLLCKRKAEKLNLDNAPFLADDPRRARRIKVFRSTRLFC

SEQ ID NO: 2446 - protein, 38 aa, synthetic construct
LWKWFSRLLKRLRRPDKIALYARALSEKRLGAFREQRW

SEQ ID NO: 2447 - protein, 57 aa, synthetic construct
LIKIFKKIWRRMQKSKNDLPYKKMLWARAYRRKAKQCYAKPLYLKLARLLHFRRWYL

SEQ ID NO: 2448 - protein, 23 aa, synthetic construct
KWKLLKRIIKKLKHDNAALKQPP

SEQ ID NO: 2449 - protein, 40 aa, synthetic construct
KYKLLRRFWKLFRKNRVRALQCPPLLLKKSAPMKLFDMRQ

SEQ ID NO: 2450 - protein, 46 aa, synthetic construct
KYRFMRRMLRRLQRAYRHRACDRGRSAHNLCANRRKLALGAFKDAY

SEQ ID NO: 2451 - protein, 40 aa, synthetic construct
KIKLLKRIWRRWKQIKAYHRARVARPRILAAPKAYKAYVI

SEQ ID NO: 2452 - protein, 72 aa, synthetic construct
MLRWLKRMFRKFNKRKLILQRALKVRELMWLWDLAAMNRRVARRRLNRMDAARKKDWRMHSCLLFTVRLIRR

SEQ ID NO: 2453 - protein, 38 aa, synthetic construct
LFKLWHRLLRMLRRRCNKKAALKRDVVQKRSGFEHYLI

SEQ ID NO: 2454 - protein, 41 aa, synthetic construct
KLKILKKFFRFWHKKKLVADKCWCPSELLPLRAHAAACLIL

SEQ ID NO: 2455 - protein, 27 aa, synthetic construct
KLRFMKRWLKKLRKSLAPSRSASNLLA

SEQ ID NO: 2456 - protein, 33 aa, synthetic construct
LMKLWPRLLKIFKPKLKHNLTRGKIIAWEALKL

SEQ ID NO: 2457 - protein, 22 aa, synthetic construct
LMKLLRRLLKKLTQLLPRDTVK

SEQ ID NO: 2458 - protein, 36 aa, synthetic construct
KFKLFCRMIRLLHKRGRALQMLRKKANFLWRSARNL

SEQ ID NO: 2459 - protein, 24 aa, synthetic construct
IMRFLRRLLRMLQPRSLTRRDLDL

SEQ ID NO: 2460 - protein, 43 aa, synthetic construct
KWKLLKRLLKYFKPLKWAYAVRRQRNKYILMWMLARLKEHAAL

SEQ ID NO: 2461 - protein, 69 aa, synthetic construct
RLKLLQKLFKFIKKKLKRHAKLLGKSRRSINATVALLLAWVNQIINKRNIKVLLVYICAKKAMQNKKVA

SEQ ID NO: 2462 - protein, 25 aa, synthetic construct
RYRLMRRLLKRWQKLREPALCSTLH

SEQ ID NO: 2463 - protein, 30 aa, synthetic construct
KIKFFRRLIKMLKRAAARPMRRALVCLASS

SEQ ID NO: 2464 - protein, 47 aa, synthetic construct
KYKMMCRLLRLLKNTHARRHKRFLHAKAQLGTRLFKEWKEVKRNMDA

SEQ ID NO: 2465 - protein, 47 aa, synthetic construct
KLKLYRKWLRFMKHIQRCNFKARAVFFNRSERAGAQKKLLLLVLEIR

SEQ ID NO: 2466 - protein, 40 aa, synthetic construct
MLKLIKKWIKKLHPDTRFHAQRLKALAYALFRWAVKMRAR

SEQ ID NO: 2467 - protein, 40 aa, synthetic construct
LFRILKKLIRKLQSKRTGHLKSKDQQVHALRPLACWLLRA

SEQ ID NO: 2468 - protein, 20 aa, synthetic construct
ILRLWKRYFKWLKRLQQGWL

SEQ ID NO: 2469 - protein, 59 aa, synthetic construct
FFRLFRKYYRKLHKCKNEWSKAAALMAWKKAPMPKAKQAADLRDAIGQLWNYILALARA

SEQ ID NO: 2470 - protein, 31 aa, synthetic construct
RMRWFRKMFRRLHNAAMCAYARKAPNRRFAL

SEQ ID NO: 2471 - protein, 36 aa, synthetic construct
KMRLIKKWLRRFRSQRCALLAAKKAFNKGNNAYSRE

SEQ ID NO: 2472 - protein, 40 aa, synthetic construct
RFKMIRRWIKKFRKLIRLPAIRLRLWRQLLAHQRVHAHPA

SEQ ID NO: 2473 - protein, 65 aa, synthetic construct
RWKILKRILRMFKKDPRAGAMKRALVRLLWRKHLADKPFIWLVLSRLVPAKALRAHRRWEGSMAW

SEQ ID NO: 2474 - protein, 27 aa, synthetic construct
RLKLISKLLRKFQKFAWRCAKLPQAAQ

SEQ ID NO: 2475 - protein, 24 aa, synthetic construct
RLKLWRKLLRRLHKAIMSSVRTLM

SEQ ID NO: 2476 - protein, 24 aa, synthetic construct
KLRIMKKLMRLLCKYGVIAKSKLG

SEQ ID NO: 2477 - protein, 55 aa, synthetic construct
RFRWLRRWFRLFRQALRRKRLPLLRHKFIRMALRNWAKAAIRDDAPPAKLTADRC

SEQ ID NO: 2478 - protein, 29 aa, synthetic construct
LFRLLRRYWKWLCHHELAPFRLRKKARKI

SEQ ID NO: 2479 - protein, 43 aa, synthetic construct
FLRMLKKFMRKWNRRPAHKYLLTCRPLLKKLFGAEKLKKFDMN

SEQ ID NO: 2480 - protein, 60 aa, synthetic construct
RWRLLCKWYKFLNRYDNSALGLEAVLYLMAALRRPAVDYQLKCKMKLRFTRTKTLKKAKN

SEQ ID NO: 2481 - protein, 68 aa, synthetic construct
KFRLMKRFLRKWQKRKKPINLAASRLKRKLAQNAMKERLAKAHTWLPLDHAKKFRAGMRSFYVACCSD

SEQ ID NO: 2482 - protein, 35 aa, synthetic construct
LLKWYRRWYRKFPKYALGLQMRAAKRVLGAHNPRR

SEQ ID NO: 2483 - protein, 27 aa, synthetic construct
ILKFLQRLFRMFTQKYPAKRKCDAARL

SEQ ID NO: 2484 - protein, 44 aa, synthetic construct
FLKFLNRFFRKIKKLTRLRALCLDGRIKAKRLRAEHRWLYFRAG

SEQ ID NO: 2485 - protein, 56 aa, synthetic construct
WYKWLSKLLRYLRRCFFIAEYKSRLHKRKRRGRYRKLECLKAGLLRHQKVQTAAAT

SEQ ID NO: 2486 - protein, 33 aa, synthetic construct
MWRLYRRLLRFWKRDPLKSALLLAAARRLRDSC

SEQ ID NO: 2487 - protein, 75 aa, synthetic construct
RYKIIRRYYRILRKCPAFKCLDHAQLRELMSKYVTFMKATAALLKAKDGARKRLFIALRLMRYIRALCARRAKPH

SEQ ID NO: 2488 - protein, 52 aa, synthetic construct
WFKFLKRLIRRLRTRQHMNKFAAALRGANQNRALDDRLNMLAALYYRWKRHA

SEQ ID NO: 2489 - protein, 56 aa, synthetic construct
LMRFFKKLLKRLKRMRYLCQQRGSRLRVPVLKKAQITAPARMLRCIARCEALRCCT

SEQ ID NO: 2490 - protein, 66 aa, synthetic construct
IFKFLPRLIKRLSHIDLGRLRPLIFRHLTKLKLHRALRRQKLREELGVACKRPTLKYRHNLAEAQA

SEQ ID NO: 2491 - protein, 41 aa, synthetic construct
FLRFFRRFLKWLNKKKIADLIKARAKLAASKRETAFWIKAE

SEQ ID NO: 2492 - protein, 31 aa, synthetic construct
MIKILRRIFRKLRQKLSLEARLLQVRKSAIG

SEQ ID NO: 2493 - protein, 68 aa, synthetic construct
KMRWICKLLRKYCRYKRKLTKLLDNRRPKNNRGALDLLQLNCFAKADDCLRLLKDALKNCPHKAAWHM

SEQ ID NO: 2494 - protein, 30 aa, synthetic construct
MLRILRKLWKKLKRLLPQTCRCPGTKALHK

SEQ ID NO: 2495 - protein, 65 aa, synthetic construct
RLRWLTRLMRRYNRSRLTKLSVAHRKPRARHKQRKDLLAGLAARAWKSFQKYYYYYTNRGAARNA

SEQ ID NO: 2496 - protein, 36 aa, synthetic construct
KFKLLHRLLKKLRKRLLKLARFQVYYRNCYITPKAC

SEQ ID NO: 2497 - protein, 34 aa, synthetic construct
RLKYFTKWLKKYTKERALAFAIALALRMAPWRKF

SEQ ID NO: 2498 - protein, 94 aa, synthetic construct
LLRLIKKLMRKLCRAKERAARYDSAANAKLQPNRWRSKLARERDHSLHLHRSFVCKAMRIVGAKRKKKSLQFNWVRASDECWGRARRLWKKAVA

SEQ ID NO: 2499 - protein, 49 aa, synthetic construct
RLRYFRRWLKLIKKQRRWLLASRAEHAALRKRIQKCKMRKAKLLSQALY

SEQ ID NO: 2500 - protein, 22 aa, synthetic construct
KLRFIQKYLKFLKNGMKACALL

SEQ ID NO: 2501 - protein, 30 aa, synthetic construct
KFKIFKRLWRFFRKLRLDPCEKYWADAALL

SEQ ID NO: 2502 - protein, 53 aa, synthetic construct
LFRLWRRLFRRYNKAQTKKPKGPFKRFLRPALKLCLRHTKNSLQLASQLDADA

SEQ ID NO: 2503 - protein, 45 aa, synthetic construct
RLRMLPRFIRKLRKWNLWTRHGTLRAHDKAIDLAANYGAYKTKLR

SEQ ID NO: 2504 - protein, 41 aa, synthetic construct
LWRMMQRMFKRLNKLRLAIIKALDNDANATMPRLPRAVKKK

SEQ ID NO: 2505 - protein, 89 aa, synthetic construct
RLRYFTRFIKKFKRCVGCWNPLYQLAAKMELARALLHKRLKKKAQAHTFKHLPIAQAVAIRADHERMAANAPKLMKRVRLVLATAKRRK

SEQ ID NO: 2506 - protein, 48 aa, synthetic construct
RFRLLSRWLRYIRPKAAYAWVTRLAKFLKARKAQPCRKQPAMVSKEAL

SEQ ID NO: 2507 - protein, 64 aa, synthetic construct
WLKLFKRFYRRFKKVKAAILLVLDRKRRLLLAKHLFLKLCKAHKKSRMFRQIHKALKARCNVAK

SEQ ID NO: 2508 - protein, 29 aa, synthetic construct
KLKFLPRLLKIMNKNFKRALLQKQLLKAA

SEQ ID NO: 2509 - protein, 23 aa, synthetic construct
RLRLLHRLMRKLKRWSAYNPDLA

SEQ ID NO: 2510 - protein, 32 aa, synthetic construct
RLKLFKKILRRMTRDLHLMEAMKKRRKMLMAL

SEQ ID NO: 2511 - protein, 21 aa, synthetic construct
RLRMLKKWLRILTKLQKKAIV

SEQ ID NO: 2512 - protein, 100 aa, synthetic construct
MLKFIHRYIRWIPRHHQMRRVRADAALVKNPARAKQNARRLKRVLLKWSRRKHTHCKARHWYAARRAPKWRLAKTLAGLLPNRKFKNARNDLKDALDRML

SEQ ID NO: 2513 - protein, 32 aa, synthetic construct
KLKWLNRFWRKYKNRLKKLTTQKLKWWLAEAY

SEQ ID NO: 2514 - protein, 29 aa, synthetic construct
KFKLLPRLMRFWPKTYRKPDLRVALATLK

SEQ ID NO: 2515 - protein, 45 aa, synthetic construct
LIKYFPRWFRKFCKQKRGARLLLKHWVLKRMKKHLLLPANAAQRK

SEQ ID NO: 2516 - protein, 49 aa, synthetic construct
LFKWLKKWIRIWKKLAACASKRRLLAMFHKKRKCLRGTACKIKLKLFDD

SEQ ID NO: 2517 - protein, 66 aa, synthetic construct
WMRFLKRLMKLIKRKRAKQCELEDILQKRKARNKHRSWCKKAFSAKLAPLHAAKRKNIALTTQKYI

SEQ ID NO: 2518 - protein, 70 aa, synthetic construct
RFKFFKKLLRIFTQNRLKAKCAKLSLKARAALLMHPRKDKQHLALKLNPLSCADTLKTANWRRCCRKART

SEQ ID NO: 2519 - protein, 53 aa, synthetic construct
RYRFLHKIFKWLRTAYNKLQRYQKCQAKAGKDQRAIAGRRARQRKARKTALWL

SEQ ID NO: 2520 - protein, 50 aa, synthetic construct
KLKMFKRLLRRWPPKLAMRTLLERHAWKLNLFRRHLIAARRPKVSKHSNT

SEQ ID NO: 2521 - protein, 52 aa, synthetic construct
KWRFLKKMMKRFKKDAQRFAAWTAAMGAALVYRLIALRWYTHRELVAGLKAA

SEQ ID NO: 2522 - protein, 29 aa, synthetic construct
IWRFLRKLMKWLRNLKLSLNLKYRADKKL

SEQ ID NO: 2523 - protein, 39 aa, synthetic construct
ILRYFHKLLKRLKNKAKRAYRLDMLANRTLNYCKMKCKV

SEQ ID NO: 2524 - protein, 20 aa, synthetic construct
LLRLWKRLFRKIKCACAHKE

SEQ ID NO: 2525 - protein, 25 aa, synthetic construct
LIKFWHRYLRRIPPKLSAKPRIARL

SEQ ID NO: 2526 - protein, 100 aa, synthetic construct
KLKLMKKLFRKFRHSLARWAGAKTWLKYKRAWRMLLKKLMLRRPNWDRKPRVKRPFICLRNKWADKLRKPQHGPPLRQKLDPRLAFALLPHGYRWGACCS

SEQ ID NO: 2527 - protein, 63 aa, synthetic construct
KMRYLTKYFRRFRRYGLILAARPAKLLLLLRADKLIYRLPSLNKKLNQKRKFIMLYRCNRGKA

SEQ ID NO: 2528 - protein, 95 aa, synthetic construct
YLRLICKLWKKWKSYWGLPWAGPKLAYFASHDEARNKSLSAKVRFAVARRNHVEEAKLLLRYHNSADFAKLWKKSVLKALLDKARNARRAKLWAK

SEQ ID NO: 2529 - protein, 40 aa, synthetic construct
FLKLWKKFIKLFKKRTCRGKRTLLSIDRFRANRNHLAENA

SEQ ID NO: 2530 - protein, 34 aa, synthetic construct
LLKLMRRIIKKLRHKYRIKAKYAYLNFWKQLQCA

SEQ ID NO: 2531 - protein, 25 aa, synthetic construct
LFKFLSRYMRKFKRVALARRQWHCA

SEQ ID NO: 2532 - protein, 25 aa, synthetic construct
RLKFLQKFFRKLNQTKRAMMALRHC

SEQ ID NO: 2533 - protein, 86 aa, synthetic construct
FMRLWRKLFKRFRPPRAIPRVAKKLGALRRKRVAHAMFEQQLAKRYLLRRLKWQFMYKAIVAREHAAKAMLQERTAWLSLQARTYK

SEQ ID NO: 2534 - protein, 36 aa, synthetic construct
FMRFLRKFLKKFCSAADPPKRFVRVLASRAAKKIAW

SEQ ID NO: 2535 - protein, 21 aa, synthetic construct
IYRLLRRLFKLIKNWKLARYL

SEQ ID NO: 2536 - protein, 44 aa, synthetic construct
RMRIWRRLLRRLHKQMLPKVKRAAAYMHLHSRLLQADCRTFAWR

SEQ ID NO: 2537 - protein, 75 aa, synthetic construct
RWKWFRKLMRKLRRLYWKCVARASAAAARLRRVGLFKVLLVAKKRLPKFGRSDLAWLKQKNLLLQQNLLRGSPAM

SEQ ID NO: 2538 - protein, 41 aa, synthetic construct
FWKLLHKFLRWLRTDLGFKLNKKALRSLEKDRWRLNWRAKY

SEQ ID NO: 2539 - protein, 60 aa, synthetic construct
RYKLMNRFLKKFSRGKYLRRVRTRKPGKHMAAMAAAWLRLKMHRNAAYKLFALPRADDKD

SEQ ID NO: 2540 - protein, 74 aa, synthetic construct
KMRLFKRWFKLIRKSPFYKKEQFMLKKVKLLYRFMALRLKIKLLRRRMKLAEDEINRAAATPKRQATAKLERAQ

SEQ ID NO: 2541 - protein, 62 aa, synthetic construct
RMKYLKKFFRLMRCASYHLRPYKCRAKRGIKQSRYAARYKFLAKRRLARILKGCPLLMIALD

SEQ ID NO: 2542 - protein, 53 aa, synthetic construct
FLKWLTRLFKRYRREFLCFALLCNKLRYYKRAATAKCPKPKSAKYRECGKIAL

SEQ ID NO: 2543 - protein, 57 aa, synthetic construct
KLKIYKRMLRKFKRLTGSRPHNALHGAAAYLKKKGSIENALRARLVRCPAWDRKDEK

SEQ ID NO: 2544 - protein, 44 aa, synthetic construct
IFRILRKWLRRFKNREAAACSLRFSCELRKLELLAKKKRIMAIK

SEQ ID NO: 2545 - protein, 43 aa, synthetic construct
FLKLFNKWYKLLSSRTAMRRLLLQMLAATALRRGQCTPKRADH

SEQ ID NO: 2546 - protein, 41 aa, synthetic construct
KLRMLKRWLKRYSQMVYAYYMKCAIKASPLTRARKAKDAAA

SEQ ID NO: 2547 - protein, 85 aa, synthetic construct
LIKMFKRLFRRLRKLDWAKNELLAIEPECNCPPLAHKLFLLGTRLHKAAKYVHKWACADVVPECRARNAAVRALKRHLLKKMKYL

SEQ ID NO: 2548 - protein, 52 aa, synthetic construct
RYRLYKKILRRMKRRALKYNYRSKYWRAMRAACWLASGAVAMDYFARDKRLA

SEQ ID NO: 2549 - protein, 65 aa, synthetic construct
ILRFWKRMMKMFKPWKAICFSLKIAMYRKCVAAYLRFLTRRRHKHFLIRLKAAMKKALKLKTTAA

SEQ ID NO: 2550 - protein, 28 aa, synthetic construct
KLRLLCRILKLWRRLEVRREIQYAAIHY

SEQ ID NO: 2551 - protein, 28 aa, synthetic construct
KYRFLTRFIRLWRKALLAEGKLHRREWW

SEQ ID NO: 2552 - protein, 44 aa, synthetic construct
RYRFYKRLLRLIRPPAAYRLILVTLAKRAAAKSHAARRSDIQKM

SEQ ID NO: 2553 - protein, 20 aa, synthetic construct
ILRLLNRYYRMLSRARAAGG

SEQ ID NO: 2554 - protein, 55 aa, synthetic construct
RFKYFRRYLKWFRQLDRFVCMHVKRRKKRELKNRRLLLVYSIYALVLWFAARALL

SEQ ID NO: 2555 - protein, 32 aa, synthetic construct
KLRLLTKLFKKMRRNLGGALMRKSRWSLNLEA

SEQ ID NO: 2556 - protein, 96 aa, synthetic construct
LLRIWQKLLRKIRRKHQKLAHWLKRKKLKKGLTRQAVTLYCMKRKAAMLLLNWNPLKDTALLLKRLALRGLRQIRNSKPTWIRERGWRKPDRSWTC

SEQ ID NO: 2557 - protein, 20 aa, synthetic construct
IFRLWKKLMKKLKSRPALMF

SEQ ID NO: 2558 - protein, 69 aa, synthetic construct
KLKLFRKLIKKLRRNALARALKRQAHVKWMQWQILELAFKRSLCDKELQRLARLAAKIKAWLARNLRQD

SEQ ID NO: 2559 - protein, 31 aa, synthetic construct
WWKLLRRLLRRLQRVRLRGLSKKKFEALNHT

SEQ ID NO: 2560 - protein, 31 aa, synthetic construct
KYRMLKKWMRRLKRALITKPLAGKQAARFRA

SEQ ID NO: 2561 - protein, 39 aa, synthetic construct
LLKLFCRWLKFYPNHRFGKHIVYFKLRAALRARRRPLYA

SEQ ID NO: 2562 - protein, 49 aa, synthetic construct
RFRILKKFLKKMKKWWALAKLKKRNAPVANHHALAQFEKHMKFAYLGTG

SEQ ID NO: 2563 - protein, 46 aa, synthetic construct
KWKMLKKWLRRYKSLEARRATDRMIIAMRAAALNAFKLNYKAAFRA

SEQ ID NO: 2564 - protein, 32 aa, synthetic construct
RWRLLRKMWRKFQTMAERRLEGVKLAAAKVGR

SEQ ID NO: 2565 - protein, 33 aa, synthetic construct
RMKLLKKLLKFMCRRLRALLMEGRRYESCKDLF

SEQ ID NO: 2566 - protein, 43 aa, synthetic construct
KLRYLSRLLRLLRRRNLVEAFQHLRERGLAVWELRWVVKWRRG

SEQ ID NO: 2567 - protein, 96 aa, synthetic construct
LYKLLKRLLRKLKRRLLLYRYMDSALFRHKRSLGIRLAAACRKMQNLRKWQKDKKKRGVNLAKRWPPASLATKSCAQLRAKLYPAGRRLQMSTMGK

SEQ ID NO: 2568 - protein, 69 aa, synthetic construct
KFRMMRKFIRRFRPNAALKKRIAEIAVLKYARAEMLLAALESPAAKRLEARKYRLKKASLWKVLRKRNN

SEQ ID NO: 2569 - protein, 41 aa, synthetic construct
RLRWITKLFRRLQCRLIARALTLPNADHLGKGKCVRRAPRA

SEQ ID NO: 2570 - protein, 72 aa, synthetic construct
LIRMIKRMYKLYPPPVLKRWPRPANIKRLLCYLNHLRNKRRGSLRRGLKRASKATLHVVMANRLRALLLRYI

SEQ ID NO: 2571 - protein, 38 aa, synthetic construct
LWKILKKILRKLRKLGSRKQLLHAPRAKHRLSVGAKKI

SEQ ID NO: 2572 - protein, 21 aa, synthetic construct
YYKFYQKLLKRLRPFELRARA

SEQ ID NO: 2573 - protein, 28 aa, synthetic construct
FLKFLRKIMRWLPHPRLRKARHLIAYKT

SEQ ID NO: 2574 - protein, 43 aa, synthetic construct
RLRMLHKFYRKLHRLNKEMLRAHPEVLYTQALAKKEARQATKV

SEQ ID NO: 2575 - protein, 71 aa, synthetic construct
FIKFLRRMFKWLRKRLKAPKQRRGHCPWRKMRDDMLPLIMRLELRKKHQAAARACDVLLAKKMGPAREWKA

SEQ ID NO: 2576 - protein, 34 aa, synthetic construct
RMRFLHKFLKKIRKQGCLNWAAYMRAPRLMWKAL

SEQ ID NO: 2577 - protein, 60 aa, synthetic construct
KLRYFPRFLRKWKSFLQLSIAGLFRNMKAFELRLKAPKRWASWKRGKPRLNLIDSRRKPL

SEQ ID NO: 2578 - protein, 51 aa, synthetic construct
YMRLMSKIMRKYKRCLWWIRIRLWRKRADLDLRAAARLPGSCAKLKCKRRL

SEQ ID NO: 2579 - protein, 68 aa, synthetic construct
WFRWLTRMFKMFQKLQSCAWDRLLLQRRKRGRKFKPMEALRKKPLGLLAARRKSKDATSLLSLKAIPL

SEQ ID NO: 2580 - protein, 34 aa, synthetic construct
IWKWLCKLLKLFRKEKRRCRAAHMRMAYALCHWV

SEQ ID NO: 2581 - protein, 28 aa, synthetic construct
RLKYFKKLLKRLCKPACEDPSAAAIAIC

SEQ ID NO: 2582 - protein, 27 aa, synthetic construct
FFKWMRRWLRMLKSAALKLRDRMCRML

SEQ ID NO: 2583 - protein, 41 aa, synthetic construct
MFRLFTKLIRMLKKLAQDNDRPLRRMKMALAVKWIRLGALR

SEQ ID NO: 2584 - protein, 83 aa, synthetic construct
RLKFFPKYLKRYRNLKRATPKHRKIGLLPKVEISHARLLFLMRKFRLLLAARPIASNHNKREAVKNFPRLQLIKAGARAWMLV

SEQ ID NO: 2585 - protein, 21 aa, synthetic construct
WYKLYSKFLKLLRKALFRAEL

SEQ ID NO: 2586 - protein, 30 aa, synthetic construct
IFKLLNKWFKLLRRWDLKDPALRRPKVFKQ

SEQ ID NO: 2587 - protein, 42 aa, synthetic construct
LYRFLRKFIRRMKKTAFLAMWMLLDRDARNRLIRLYGRKRWQ

SEQ ID NO: 2588 - protein, 25 aa, synthetic construct
YLRWWRKLLKILRTLCAFIKRANKE

SEQ ID NO: 2589 - protein, 85 aa, synthetic construct
LLRFYSKLFKKLRRMHIEHLREALTKCYTKRKLALKLKRCKAKFYYRASSYESAVAKAKSEKKAMPPGARKMGKKYWRDIRKANA

SEQ ID NO: 2590 - protein, 39 aa, synthetic construct
FLKLLCRWFRRLRKDAGMLAGRAIWQKARIAKQVLSNAV

SEQ ID NO: 2591 - protein, 20 aa, synthetic construct
LFKLLNKLIRKFRRHLRTNL

SEQ ID NO: 2592 - protein, 77 aa, synthetic construct
KWRLYSKIMKRLKPLRSRYHKPLWLKRAQAASCNASAGLAYGAACPSREPKAIEKRALALGRVRLSDKHRADLAVKP

SEQ ID NO: 2593 - protein, 23 aa, synthetic construct
RMRLIRRLMRRWKHFSKAGAALI

SEQ ID NO: 2594 - protein, 26 aa, synthetic construct
YLKMFHRFLRRMKKDSRSLFLLLRAM

SEQ ID NO: 2595 - protein, 30 aa, synthetic construct
LFRMLKRIWRRIRTAFAHVKRHARAGLAWS

SEQ ID NO: 2596 - protein, 30 aa, synthetic construct
KLRWFKRWYKILKRLAAAPKSARLLRDGCG

SEQ ID NO: 2597 - protein, 54 aa, synthetic construct
RYRLINRFFRLMKRARQLLMKRRAVPLAMLIRELCHLVNLKRTTAAQKDDLSSA

SEQ ID NO: 2598 - protein, 70 aa, synthetic construct
YIRLLRRLLKFLRKELAAFNYAHIRAALMGNNRWAALAGIYVATPLLRYACHRKLPCKWKRKAHVRPKIQ

SEQ ID NO: 2599 - protein, 34 aa, synthetic construct
RFRLLKKFMRILRRFPGRRRPLAASPKLLVIKLT

SEQ ID NO: 2600 - protein, 20 aa, synthetic construct
KMRWFTRLIKFLKKMLQLSA

SEQ ID NO: 2601 - protein, 21 aa, synthetic construct
RFRWLRKLLKFLRCEMATLHL

SEQ ID NO: 2602 - protein, 48 aa, synthetic construct
RIRFLKRFLKRFRRLALSFPLAWWECAKYARERLNALAFLKYLWGGAR

SEQ ID NO: 2603 - protein, 47 aa, synthetic construct
LLRIIRKLYKRFKRTRDASCFFCWAQYSRLDAKGKAAAQLKKMTGRA

SEQ ID NO: 2604 - protein, 48 aa, synthetic construct
LFRIMSKLLRRWTRALEAEVHHKKAWARLRVALKLLLKKVRRQRSQCT

SEQ ID NO: 2605 - protein, 30 aa, synthetic construct
FLKFMKRLLRKFKRVATKLWGKNAKLNAVH

SEQ ID NO: 2606 - protein, 52 aa, synthetic construct
RYRLYHRLFRIFTRVRYRKMKRDCLSLNRRCALARRAYMKLAQFTALRCPEL

SEQ ID NO: 2607 - protein, 30 aa, synthetic construct
LLRMMRKFIRMITRFFAKAARLYAIKLDAK

SEQ ID NO: 2608 - protein, 36 aa, synthetic construct
RIRLLCRIWRFITNLDLASRLRFKASNKNGRKADLA

SEQ ID NO: 2609 - protein, 27 aa, synthetic construct
KLKLFRRYLRLLTNVYKQYQNLAFCRL

SEQ ID NO: 2610 - protein, 39 aa, synthetic construct
LLKLLSRIMKRYPKEKRLRRKLLLKKACHPFNLSGFARI

SEQ ID NO: 2611 - protein, 69 aa, synthetic construct
YFKLFKKLLKRYKHYLRTTAWRLQYKKRLAWRQDLLSLHSYNQLPLIRYRKFANSLCWKILRDALVLKK

SEQ ID NO: 2612 - protein, 45 aa, synthetic construct
RFRFLKRMYKKLPKVAHMLNMEQLLPAPKRRMDRRSVNLNLARLR

SEQ ID NO: 2613 - protein, 21 aa, synthetic construct
FLRLWSRLFRRFSRRLTWALE

SEQ ID NO: 2614 - protein, 91 aa, synthetic construct
KYRLYRRLLKLWRRAAGKRYTRCRTACGWHNARAAIPLLREVVDWAAAKKKWAKVRKKGAYYRKPNHKMKLADKYANQPHFRLSKRYAKRK

SEQ ID NO: 2615 - protein, 49 aa, synthetic construct
RLKWISRYIKKIKRRFKRKFAAQIHWRMNAKLAWPVKALLDAEAAHIKL

SEQ ID NO: 2616 - protein, 56 aa, synthetic construct
LLKLIRKLFKRYNREMLAWPACSAAYRKLLLFIKVRLASETKLLIDTICKLLIIKG

SEQ ID NO: 2617 - protein, 44 aa, synthetic construct
KMKFLRKLIKLFHRLLRKALRSRTYAVMRMCLYKAANRHLVLLR

SEQ ID NO: 2618 - protein, 32 aa, synthetic construct
IFKFLKKYLRRMKKCRMFLLKLCLRKCLLSPV

SEQ ID NO: 2619 - protein, 98 aa, synthetic construct
KFRFLRRWLKKYHPRAVGRARKIHSAGMCIKFRYKKKAAKAIEGEARKYLSRVCRAGARAKCKLELILHLAKKQQLYALALARDDMRSKTTFETVTKK

SEQ ID NO: 2620 - protein, 90 aa, synthetic construct
RYKLLRRLFKLFRSKRRLKALYNKEDRSKQRLSSAVNAMLHWNNTSCRRCLAWLKRLHKGRARLSRRRLRELRALSAASLNGHRSRQQEN

SEQ ID NO: 2621 - protein, 24 aa, synthetic construct
FLKFFRRFLRRFKTAKRQLAHPIA

SEQ ID NO: 2622 - protein, 58 aa, synthetic construct
RLRLLRKYMRRFQRKPGGAFTLAKAWHNTKLIEVLRNLRLLKKEKAALQTGDRTLLEA

SEQ ID NO: 2623 - protein, 85 aa, synthetic construct
RIRLYTKLMRRLKTPAPEKCRAKSRLRLPDSLKLRTKGRRVQTAAVWKLATIRRNAAAAVNKYMQLLRDQAAKMKFARVYRKTAI

SEQ ID NO: 2624 - protein, 54 aa, synthetic construct
FIRLFPKLLKYWSKELIRMAIQKGAAALSLLARQAKVGGMRQKCLRYKNLKDRA

SEQ ID NO: 2625 - protein, 29 aa, synthetic construct
RWKFWPRWLKMMRRLAWGKALICLKAHKE

SEQ ID NO: 2626 - protein, 71 aa, synthetic construct
FFRFLTRMFKLLKRAYHKIRPRCNNDTAKQWQRARLAKRAGARSWRKKRYKIILLYARNLLRADGDAARRE

SEQ ID NO: 2627 - protein, 22 aa, synthetic construct
LWKLFTKILKRMRKWPLNAKKA

SEQ ID NO: 2628 - protein, 75 aa, synthetic construct
LFRYIKKFIKKMKRLARWLRARQWQMAALNKAAKATGKALALQAKYLRHAKRILDLMDDKLQASEFKAEDSRFHG

SEQ ID NO: 2629 - protein, 48 aa, synthetic construct
LFKLLRKYMRKLSQGLLMAKFEKKHQKANRAAHGARSKKKAKKRALEP

SEQ ID NO: 2630 - protein, 64 aa, synthetic construct
ILKIWRKLYKILSKRSQKMRRGDLGYAWRAAPRLILGQKDRAGSLALPKPCKRLQNLANLCAAL

SEQ ID NO: 2631 - protein, 43 aa, synthetic construct
LWRFLRRLLKKYKRTRYPWWAAKCLQRQARMHVNAAQFKMALC

SEQ ID NO: 2632 - protein, 21 aa, synthetic construct
RIRLYKKLIRRLRHTAYWAEI

SEQ ID NO: 2633 - protein, 79 aa, synthetic construct
LLRYIQRLMKRFKRFGVFRHGFAAFWCLALLNAVLQINKKPELHRWKSRKADLKEAARKNKRLKKAADVRLRVARRKAR

SEQ ID NO: 2634 - protein, 45 aa, synthetic construct
RYKLLKRFLRMIKRALAALKLWMLKRLELGYASHRRDRSKLKYFP

SEQ ID NO: 2635 - protein, 88 aa, synthetic construct
KIKIWKRLFRRYQKKFRTKLLCAMAILAKMMNKIRKFNMMLMHRAWLMMRPRTAKAKPATLAQFLKQQQVALRLHANAFALKHLPKLR

SEQ ID NO: 2636 - protein, 53 aa, synthetic construct
LLKLYRRMLKFIRRPNVKARRHAAHSLSKRHAFRKKCRGCWRAARSALAQELG

SEQ ID NO: 2637 - protein, 39 aa, synthetic construct
RLKFLQKWMKFYKQELQMLFPMLARQLNEKALKAARFAR

SEQ ID NO: 2638 - protein, 36 aa, synthetic construct
LMRFLRKLFKKLKCADGHYLVACTMLRRLMKEALAK

SEQ ID NO: 2639 - protein, 20 aa, synthetic construct
RWRLFKKMLKMLCNALNWLH

SEQ ID NO: 2640 - protein, 52 aa, synthetic construct
LLRLFCKFLKKMRKRLLLHAVFVRKELETDRSTRWRKKELYAPHAKKAWRLM

SEQ ID NO: 2641 - protein, 73 aa, synthetic construct
FLKLLHRFYKMLRKFHALWVIALLNADKPCKLLLAKRRNTKKRDLYHRSKLNKCLPRREGQLKIDDRRKMRAA

SEQ ID NO: 2642 - protein, 40 aa, synthetic construct
FLKLISKYIRRLRCYPCIRPGKDLKALLKLRKDLLAAMWL

SEQ ID NO: 2643 - protein, 29 aa, synthetic construct
FFRFYSKWLKIFHRLKLGRAELLAVKTKR

SEQ ID NO: 2644 - protein, 29 aa, synthetic construct
RMRFLSKFLRYFKNRAFAAVDILALARGK

SEQ ID NO: 2645 - protein, 20 aa, synthetic construct
FYRLLKRILKLYPRIGRAEA

SEQ ID NO: 2646 - protein, 42 aa, synthetic construct
YLRLFNKMLKIFNKTASPAKAHLLEARKAKLSLKLIDMYRLD

SEQ ID NO: 2647 - protein, 28 aa, synthetic construct
RMRIFRRLLKKIKHGAQRFKGFALAGAY

SEQ ID NO: 2648 - protein, 49 aa, synthetic construct
FFKLLSKWIRFFNRLGLREKRGDLLQRKLALIAKNFDRSVLAYLPLKLQ

SEQ ID NO: 2649 - protein, 20 aa, synthetic construct
WLKLYKRMLKWMHKLSGWKL

SEQ ID NO: 2650 - protein, 60 aa, synthetic construct
FYKILKKMWRKLNRYKLKAIETRIRVKFGNDRYFDKLLRLAMVKAMRARKKMLWLLITAW

SEQ ID NO: 2651 - protein, 43 aa, synthetic construct
FWKFMKRLWKLYRSRSRACVELKKLGLKVYKRRAHFMLWALLY

SEQ ID NO: 2652 - protein, 25 aa, synthetic construct
RYRLLRRFLRFMRHWGFAYAAKVKY

SEQ ID NO: 2653 - protein, 25 aa, synthetic construct
KLKFYQKWLKLMRRRYAANKAQIML

SEQ ID NO: 2654 - protein, 44 aa, synthetic construct
RIRIFRKYLKRWKQRMALLAIRLYLAYERALGSLARKWFRVALT

SEQ ID NO: 2655 - protein, 32 aa, synthetic construct
LLKFMCRIYKWYCKCAARSLAKKEKAGVPKLK

SEQ ID NO: 2656 - protein, 96 aa, synthetic construct
RLKYMKKMMKWFRKKRKLLHLRRLTKYKTAAQKAAAKLKYSKQKYQRRAPRHLNGAAMCDPAAFDLAHKRIQRLAEMLGKAWRIRACRLQCRLKYC

SEQ ID NO: 2657 - protein, 31 aa, synthetic construct
RYKFLKKLYKRFHNVLRAFPRIKLALRNANK

SEQ ID NO: 2658 - protein, 41 aa, synthetic construct
YIKFLCKMFKRICRARRAARKLKCLAHAWALCPYPKVTPRR

SEQ ID NO: 2659 - protein, 33 aa, synthetic construct
RLRWLHRFLKFIQKISQEKDRKLAPRRLAGLQA

SEQ ID NO: 2660 - protein, 98 aa, synthetic construct
FFKLMSRLMRKYSQYGAWKKAWHRLAEQNMHYTLFWKYKLVLKKFALRRRKRLKPKKRTLTARLLGLRKRKAEFLARKIARLLAKEAAFIRICRKLLN

SEQ ID NO: 2661 - protein, 53 aa, synthetic construct
RLKWLTRWFRMYKRKALKTKLHLKLALEKTSPMLAALSYAYLGGHHHKKAAKL

SEQ ID NO: 2662 - protein, 20 aa, synthetic construct
WFRLLKRLWKLFPKCAQMKM

SEQ ID NO: 2663 - protein, 47 aa, synthetic construct
KLRFLKRLIKWMRQPSRVLILASYMVQGLLKSAKKSWAGRKKLFKSK

SEQ ID NO: 2664 - protein, 79 aa, synthetic construct
RLRMMKKLWKKFKRRLIKRWAIALRTFYLARWFQASACALCKLSLKPDAGTFPKWNLLLLYKLMLKTRWHKMLRKNFEN

SEQ ID NO: 2665 - protein, 27 aa, synthetic construct
KLKIMCKILRRIRQRARVPLLRYNLHA

SEQ ID NO: 2666 - protein, 29 aa, synthetic construct
RLKLIKRFWRKLKNLRQRQASHLPYFGHA

SEQ ID NO: 2667 - protein, 50 aa, synthetic construct
RLRLLSRFMRKWPKKAGDMDRAALLEGLWLGANMLIAPHLAIVWKGKLRR

SEQ ID NO: 2668 - protein, 28 aa, synthetic construct
KYKFLKRLLRLYKHATHPMKSQDLLWKR

SEQ ID NO: 2669 - protein, 48 aa, synthetic construct
RYKLWKRLIRKFKKKRCYMLLNAAADWPEGGKKKLLLACCPLFRAFKA

SEQ ID NO: 2670 - protein, 45 aa, synthetic construct
RIRLFRKWLKLIHKQAPSIAAYKKRRLGFDKAPAAAIALGRARAR

SEQ ID NO: 2671 - protein, 25 aa, synthetic construct
MLRWLSKLLRLLRRIHVCNRLATRR

SEQ ID NO: 2672 - protein, 47 aa, synthetic construct
KLRYYRRLLRFFKKYFECLEKDTLARLRMRDLLVRNKRFAIAAYQTL

SEQ ID NO: 2673 - protein, 32 aa, synthetic construct
RIRLFRRILKFLRTAALYNRKAWKCMPALALS

SEQ ID NO: 2674 - protein, 33 aa, synthetic construct
YWKLLSRLLKRFRKLNCMKRRPSAGRRDFLPFL

SEQ ID NO: 2675 - protein, 50 aa, synthetic construct
WMRFFKKFFKLLKPKRTWQLLRALHRAIMAALRMLKLGLAYNKPEKHKKS

SEQ ID NO: 2676 - protein, 62 aa, synthetic construct
LFKMMNRWYRLLKRRARLLRPLKDGKERSRQTKPKCLCKARALHPPSASDTDLRRLLLARQA

SEQ ID NO: 2677 - protein, 86 aa, synthetic construct
RIRFLPRWMKKIKKKLARATEKAAIHWKRTASAKVFLRLLRHCKRYNAKKPKQLAKALLVYYKSGAKIRTVAAKKPKTVIFKSAPI

SEQ ID NO: 2678 - protein, 46 aa, synthetic construct
LLRLFKRMFRKIRHKLLRHLLSKPMLYRADYAPPHRTNDIIAAKKA

SEQ ID NO: 2679 - protein, 30 aa, synthetic construct
KMRFWKKLLRLLTTPESRSVLRMRLPLRLL

SEQ ID NO: 2680 - protein, 31 aa, synthetic construct
LIKMLRKLFRRLKKAKKQKWPLLLKACWLKD

SEQ ID NO: 2681 - protein, 37 aa, synthetic construct
KLRLLTKWWRRFRRENTLALHDGAKLYHRDLGAAMKV

SEQ ID NO: 2682 - protein, 36 aa, synthetic construct
YLKLLRRMYKRMKRLRQARWCRGFMQNGALLPASAA

SEQ ID NO: 2683 - protein, 60 aa, synthetic construct
RLRWLPKMLRKFKKLDLDKTKHRAAHTPNTKTSLGLWMTRKGASGLNVAKRLLDAHSRKR

SEQ ID NO: 2684 - protein, 41 aa, synthetic construct
KWKYLCRLLKKFRKQHKLLRLQLANQNLDAMFNCGRRLKLI

SEQ ID NO: 2685 - protein, 43 aa, synthetic construct
MWKILKRIFKRMKRRHGRALCLCKLLLNSLLKSWINRKPDLCL

SEQ ID NO: 2686 - protein, 53 aa, synthetic construct
RWKFLKRWWRMLKKLHLQSAASGYTFAAARLARLACWANYSLAKNDLKLCRSR

SEQ ID NO: 2687 - protein, 22 aa, synthetic construct
RLKLYKKWYRKIRNAHGLHAIL

SEQ ID NO: 2688 - protein, 64 aa, synthetic construct
WFKYFRKLFKKLPRRRARAKPKRKAGAVRKDLVYASKIRNDLRRRLWYCLMAAWVTLRAEYLTR

SEQ ID NO: 2689 - protein, 23 aa, synthetic construct
KLKLMRKLLRFMRRFPHYLSPLK

SEQ ID NO: 2690 - protein, 46 aa, synthetic construct
WFRLLKRLFRKLCSPPIRRWFAFPCHRARKWRLWGLRRIKAKDQAA

SEQ ID NO: 2691 - protein, 24 aa, synthetic construct
RLRFLSKLFRWLRRLRKDPLRVDL

SEQ ID NO: 2692 - protein, 43 aa, synthetic construct
MFKFLNKLLRKFRRQHKRCLSALMTAKLFQALLCASGVKRASE

SEQ ID NO: 2693 - protein, 69 aa, synthetic construct
FFKMWKRLWKKLKTRQAALATRSHNTRSRDWRLRKKDKLARAFAWTHSGKLNADVALAAALGTSLYWSR

SEQ ID NO: 2694 - protein, 30 aa, synthetic construct
WIRILQRLIKMYRHKKKYLFLALRTSALKL

SEQ ID NO: 2695 - protein, 31 aa, synthetic construct
KLRIIRRLFKWLTKFLAMKWTKLAQKLYMLA

SEQ ID NO: 2696 - protein, 38 aa, synthetic construct
RLKLLRRFWRKIKTFLVEAQEKIPANAARCLAKKGHNE

SEQ ID NO: 2697 - protein, 25 aa, synthetic construct
KFKLFKKLLKKMKTLDLARKATINH

SEQ ID NO: 2698 - protein, 30 aa, synthetic construct
RLKYFKKFLRMWKSILKAKNIAKQAAAEVN

SEQ ID NO: 2699 - protein, 48 aa, synthetic construct
RLKFIRKILKILRKRLLQCLGKLKQAGRIALCKKVAEVLRNGAACLAL

SEQ ID NO: 2700 - protein, 73 aa, synthetic construct
ILKMYSKILRFLRCQTARFQHRAKKYRRARLLKGIAKLLRPHWRSHKQCRLASAANLMIKLLNLAGAMASNMA

SEQ ID NO: 2701 - protein, 66 aa, synthetic construct
LIKLMRKYLKKMKRMDILVARYGFRARACAFRKLRRDRRLKSGWAWKRKIAWAWYHHILAAARNCV

SEQ ID NO: 2702 - protein, 90 aa, synthetic construct
FLKLYRRLFKRLKKRPLLKAKRDKKKLKVRNMKPAALALLCRLMRAHMIWPTKKANFMRDRVMVKLNIWVLRALYKHQKIRARHHPRGIK

SEQ ID NO: 2703 - protein, 39 aa, synthetic construct
RYKFYRRILKLFKKEPARQLLWLKLALLANRHLNDNRDY

SEQ ID NO: 2704 - protein, 24 aa, synthetic construct
LMKFMRKLFKRLKSQASAKTQILA

SEQ ID NO: 2705 - protein, 43 aa, synthetic construct
LLKYWKRLFRRLKKPYRDASLMRIALAFDLCAQGRALRECDAP

SEQ ID NO: 2706 - protein, 49 aa, synthetic construct
WMRFMRKFFRMIPRSTKPPRLANKLLRKARAWRTALKNAAQKKKATQAA

SEQ ID NO: 2707 - protein, 67 aa, synthetic construct
FIKLFKKYFRMLHRELAAGAGKRKERRVVATRGDLRKLARNKRLYAIKYARDCDRSLHLRWAYSGRE

SEQ ID NO: 2708 - protein, 79 aa, synthetic construct
KFKILKKLMRLLRQFWRCFIKYHLLKLKPVVVAAKLKLRRKKKAMARKLGKSCGKMLGDNNHQKLAKTMRLSPRALFLA

SEQ ID NO: 2709 - protein, 28 aa, synthetic construct
RFRMYRKLLKLWKCYAHRCLEARLNLRT

SEQ ID NO: 2710 - protein, 29 aa, synthetic construct
KWRMMRKLYKKFKCVARLTKYKAALAAQE

SEQ ID NO: 2711 - protein, 77 aa, synthetic construct
FLRFLKRWWRRLHKYLYVHRYVGVGLPLLAFYQTAAMMKLKLHGIKPLALMKRRKAVAAAILKETPLYKKNLKSALR

SEQ ID NO: 2712 - protein, 38 aa, synthetic construct
LMRLIQKLIRWLRRLCCRLRDKVKAAAPARSAGERDAV

SEQ ID NO: 2713 - protein, 29 aa, synthetic construct
LFKILKKFLRKLRKRHWLCAALADHFMEK

SEQ ID NO: 2714 - protein, 37 aa, synthetic construct
RFKWFHKILRLYKRAAKRAFLDKRLHLHPVLLKWKKN

SEQ ID NO: 2715 - protein, 50 aa, synthetic construct
LFKILKRLWRKIKRCYKCARMMPQRMAARKAKPKACSEKAFDARALENST

SEQ ID NO: 2716 - protein, 50 aa, synthetic construct
MFKFIRRLLKWWSHLDGDLVACRALAPKIVRLNKKAHYRRAIAKDKRLMR

SEQ ID NO: 2717 - protein, 62 aa, synthetic construct
KWKYMNRFFKLIRCVRLLLLKPRKARYKWIIQRALRLRAKYVATKALKIKKRAAWESLKWML

SEQ ID NO: 2718 - protein, 20 aa, synthetic construct
FMKFLSKLLRKINRLLKKCA

SEQ ID NO: 2719 - protein, 29 aa, synthetic construct
KFRLIHRFLRLYKKHAHYLRATGLWAYRA

SEQ ID NO: 2720 - protein, 34 aa, synthetic construct
MLKYWHKYLRLFQKRFPAARLNRRKSHSKKNALA

SEQ ID NO: 2721 - protein, 73 aa, synthetic construct
RLRYMKKILKILRCATNVHGRRKFEKLWAWLRKAYIAGADAKLKYLAGRCAKERKMAKQLAYVAYLSEAHRDI

SEQ ID NO: 2722 - protein, 29 aa, synthetic construct
KLKLWNRYWRRIRKLMFWRRCAHALAWLT

SEQ ID NO: 2723 - protein, 48 aa, synthetic construct
KFRFWNRMLKLFRPNLRLMLISYIGWRLLPRGRWLALAKDKAALKAER

SEQ ID NO: 2724 - protein, 83 aa, synthetic construct
RLKMLHKLWKKWCHLLKGAPQYRLPPKIVAEAKMNSACRLCRDDRSAAKGRGKKYIDKKCKKRLSKSRLRKLKQSLDKNMLLF

SEQ ID NO: 2725 - protein, 67 aa, synthetic construct
YLRLYCKLLRKFRREACWFRRMYSMSALCRMYWRDAKKGANKIKIRALTRANLRAALRALMIAACCQ

SEQ ID NO: 2726 - protein, 98 aa, synthetic construct
FYKFYKRIFRKIRKTHKKANHLLPATSLANGMRDKDQWLMALGHVKKKLRLTRLSVAHVVRIADRSEAKHLKAARKKESNARRKAKLTLGRLKLAVSE

SEQ ID NO: 2727 - protein, 77 aa, synthetic construct
LIKYLKKLWKILKKLKLLWQRTTFLCMSKSHQEAARLDRRGGWAAARLPHRVHGDKVDKRKCLANANKKQKAVRADL

SEQ ID NO: 2728 - protein, 92 aa, synthetic construct
FWKMLKRFLRKIKRWAHLLYRRMGRAKYKANAHRLWLLDQHRQLNKLRDRADLKLKMEWYTRPARRILAKHACWRKSLLRKCNVRDEAGLQC

SEQ ID NO: 2729 - protein, 52 aa, synthetic construct
KFKLLCKYIKLMPRKRAMWALQGRRWRLKLFAWEYKAAKSEKAWVERRMRLC

SEQ ID NO: 2730 - protein, 38 aa, synthetic construct
KLKILCKLIRLLKKPKSNCANKIILWNRAAALMVEKDK

SEQ ID NO: 2731 - protein, 57 aa, synthetic construct
RLRFFSKLLKRWRHAKCKKFEPNAMGQKLKHYLRLHWKLMKVRQLPLALNLKRLMAY

SEQ ID NO: 2732 - protein, 33 aa, synthetic construct
KLKMLKRFLKKLSRKAPFALHNARLKHQLLADK

SEQ ID NO: 2733 - protein, 53 aa, synthetic construct
RWRILRRLLKWFKNRALERLMVCLTYVRQASRGLMKKRLKLLKDLRLLERFTN

SEQ ID NO: 2734 - protein, 41 aa, synthetic construct
RYRMLRKLLKKWRHATHHKRVWDLKRWRRACLLPATWGALH

SEQ ID NO: 2735 - protein, 78 aa, synthetic construct
KLKLIKRFLKRFKKARTDHAFVARRMKNPPKMHPLQTRNPIAYALRRKALFPLRARRILASRTHACAKAEEVMLRGIL

SEQ ID NO: 2736 - protein, 32 aa, synthetic construct
KIKLIKKLFRRWRPLRLITKETAAMARAWLYL

SEQ ID NO: 2737 - protein, 48 aa, synthetic construct
LLRFYKKMLRLYNKCWVRLRLCPCKAQSLNCPLKAAKGLWHFLARKKR

SEQ ID NO: 2738 - protein, 65 aa, synthetic construct
RLRYYTRFLKRFKHREALKFCNKCTKYRQYVLLKIKLAAMLRALATCAKDKSLSRAKVFFAKCRI

SEQ ID NO: 2739 - protein, 67 aa, synthetic construct
KMKFLRRFFRLIRREVQRLLVFKLKSAKADGGKVKKRAQLPSAALLLASLHLTFNRKRGNRRWHHLS

SEQ ID NO: 2740 - protein, 27 aa, synthetic construct
ILRLFHRLWKKIQRASAHQIAVAKRNR

SEQ ID NO: 2741 - protein, 21 aa, synthetic construct
FFRMYPKIFRWLKNARAKALR

SEQ ID NO: 2742 - protein, 52 aa, synthetic construct
KYKWFRRYFKLLKNYRTKKAAVPYRRLLLFTKAHLAPRALKILDKVRLCRLI

SEQ ID NO: 2743 - protein, 56 aa, synthetic construct
YLRLFRKWLRKFTRALAARIADFAWAYLHKSRAKKCANAMKLQKLHKLYVDAATVM

SEQ ID NO: 2744 - protein, 37 aa, synthetic construct
FIRLYCKMFKYMNPRAHLLLAARLFVRNRCAKRKRAS

SEQ ID NO: 2745 - protein, 20 aa, synthetic construct
IMRLLKKLLKMLKPQKMPLR

SEQ ID NO: 2746 - protein, 26 aa, synthetic construct
FIRWFTKWWKRLRCARRLADLLKKAA

SEQ ID NO: 2747 - protein, 40 aa, synthetic construct
RLKLLKKFFRFFTKYALWRKGRFARAFRHRYFYLKMKALA

SEQ ID NO: 2748 - protein, 60 aa, synthetic construct
RWKLLRRMLKKFSKASKQLPCRALKLQDQCCLALPAMEIAFAMKKAARVQAKMPNLAGDG

SEQ ID NO: 2749 - protein, 35 aa, synthetic construct
KLRILRKLLRKWSSMHRLIYMLIAAKRRFCAYTKL

SEQ ID NO: 2750 - protein, 100 aa, synthetic construct
LFRMLTRLWRKYKRLHKHRLDRWSKRKMQAIAREKMRKLAHDPNPAMYLDTVHLDLILKTAMILRSMPILLEDKLARMRSPSARALLAALFRDPKKAVKA

SEQ ID NO: 2751 - protein, 27 aa, synthetic construct
YWRMFRKLYKRMQRLALEQLHKALQLD

SEQ ID NO: 2752 - protein, 34 aa, synthetic construct
FLKLLRKLFKLLRNQHEYSLKLVRVCLDTHLKRI

SEQ ID NO: 2753 - protein, 39 aa, synthetic construct
RFKMFKRLLKRLKRLRPPTLQHLKAAQGYGAADKKLKPK

SEQ ID NO: 2754 - protein, 22 aa, synthetic construct
ILKYLSRLLRKIKNRRLEDLMA

SEQ ID NO: 2755 - protein, 24 aa, synthetic construct
RLRLMKKMLRYLPRLLKRTDQMLM

SEQ ID NO: 2756 - protein, 43 aa, synthetic construct
RIRMMRRWMRKFKRRPAFMARYTLPLRSLYLAQLYWKRLLVNL

SEQ ID NO: 2757 - protein, 96 aa, synthetic construct
RYKFMTRFLKKIQRLKSLLELDLKDALRFPKRRENLRRGNNHLKKDGELVKRARFVKLTAYWYKDRGARLALKWPKAPDVRLRMPRLGNAVAKKLY

SEQ ID NO: 2758 - protein, 92 aa, synthetic construct
KLKWIPRLIKLIKNSDTNMLLTKRGALLADLQRMLDFVKAKMARRFARRAKHDEYLKGTKMHYAELDRIWKKSAARLRAKEKRNNRLDRRCC

SEQ ID NO: 2759 - protein, 47 aa, synthetic construct
KLKLLRKWMRLLKSLALQVKFNKLRPLLDRQKYKKRPWAYRWTNLQN

SEQ ID NO: 2760 - protein, 37 aa, synthetic construct
LYKFLHRYFRILRRVKCCLPKKRLKLKAHARLENKAP

SEQ ID NO: 2761 - protein, 82 aa, synthetic construct
KMRFMRRLFRRFKRWKWYRTLRYHKQAAAPISARILKALRSAKLLMKRKLEAKLRLRKQKIQPVRAALKGKEAAIRIKPFVE

SEQ ID NO: 2762 - protein, 34 aa, synthetic construct
LFKWFSRWFKWLKKAKLTWSLKTKARLHLNERKG

SEQ ID NO: 2763 - protein, 61 aa, synthetic construct
KLKFLCKLMRKFHKAPRKCANRNPRRLRGAKVANEAKPHLLYGRGAVLKKALLTECLPLCL

SEQ ID NO: 2764 - protein, 76 aa, synthetic construct
KLKLLSKMYKRLRCMGFVHCFKKRNKADACWLGAEKCFKLLLKYSALDDRKMNLKLARISTEAQLLASPLLLRRLK

SEQ ID NO: 2765 - protein, 59 aa, synthetic construct
MLRILKKWMRLFRNFYLHLMTRLRIRLWKKKLCALFGKQEARYPRQLKKGNARCKDNKL

SEQ ID NO: 2766 - protein, 41 aa, synthetic construct
LWRYLKRFMRMFPRLCRRRYWKAGALRQRPLSLELKKAKCS

SEQ ID NO: 2767 - protein, 47 aa, synthetic construct
KLRMFSKFLKRFSHAPRRRLKATMLSRRNAIGNYAARDLLDNRRRAL

SEQ ID NO: 2768 - protein, 68 aa, synthetic construct
RYRILHRLMRKIRNCFPDKLKLAFCEKLRRPAQQKEKLLAFKENHAMKPRRIKVANRDKQALNKLLDL

SEQ ID NO: 2769 - protein, 25 aa, synthetic construct
RLRMLCRILKKYQKLKLLDNRKACN

SEQ ID NO: 2770 - protein, 94 aa, synthetic construct
RIKFLTKLMKLYRRPYYFGKMLLCAKPWLRRAQITLARALVKDTDRRAVGYLKELFNRESKAYPRKARCRLLWHAKSYFQAKAKLEALEGLLLV

SEQ ID NO: 2771 - protein, 58 aa, synthetic construct
KIRMLKKFIRRLHRQADFSRRELWLALACLMWCIRLTWECPASRAKLCALAKLARHAW

SEQ ID NO: 2772 - protein, 57 aa, synthetic construct
RLKIFKRYWRLLKRIALPGAPRNKIVLDRRVNAAKQRLKRECLLDKTYHRKMEYDLA

SEQ ID NO: 2773 - protein, 29 aa, synthetic construct
RLKLLCKLIKKLKRARHIGAAWKWVLQAR

SEQ ID NO: 2774 - protein, 63 aa, synthetic construct
RFKLLRRIFKLFKPWNIRIAVVKDLADNKAPLQKNLFLKHALMKAAAGDLIKYRLRPPLAMLT

SEQ ID NO: 2775 - protein, 35 aa, synthetic construct
KIRLFRRFFRKLKHRAVNALPLGLGVLKPEHAKKS

SEQ ID NO: 2776 - protein, 45 aa, synthetic construct
MIKLLSKWWKFWTRKRLTWAFLKKSLCKATKRRKAKDALKIYCAL

SEQ ID NO: 2777 - protein, 39 aa, synthetic construct
LFKFLRKILRRMRRTLRACRRQLRAIAIMGFEAQRYSAI

SEQ ID NO: 2778 - protein, 51 aa, synthetic construct
IFRLFRRFWRMYKRRQAAGWCQKLRMAKHKLACRLKRWILALLFCTRRSRI

SEQ ID NO: 2779 - protein, 70 aa, synthetic construct
FMKLFPRFLKRWRREKELACLMLNYLRSAWFDAELWSNELLLFRWTIAVLLRRFKHRKRSARSRAEAKKA

SEQ ID NO: 2780 - protein, 27 aa, synthetic construct
LLRLLCRLFKRFKKKQSGNTLMVRFIL

SEQ ID NO: 2781 - protein, 39 aa, synthetic construct
RLRLFKKFIRFYKQAKLWRAAKEAAHHLCWPSLVKVLCL

SEQ ID NO: 2782 - protein, 70 aa, synthetic construct
LLKLLKKLFRMLCCGLVKEMRADGLKRTLWKKHKFTAQHQVAKIKLRKRARWLKGCAYLDRNDYKQKRVW

SEQ ID NO: 2783 - protein, 34 aa, synthetic construct
KIKLLKKLIRKWKRYHERRALLARVNLPLQLVVE

SEQ ID NO: 2784 - protein, 21 aa, synthetic construct
RLRLMHKYFKLIRKARLLCAL

SEQ ID NO: 2785 - protein, 92 aa, synthetic construct
KIRWYKKMLKRLKTLIPFKLLRKRGNANPALLCRNKALMWCLKLDKLGLDDFIPWKSIMRNRFLNKLRARIRPLKWFTQKDLVALCALKKRC

SEQ ID NO: 2786 - protein, 24 aa, synthetic construct
ILRIFHRYLRKIPKLWRAAAAKFH

SEQ ID NO: 2787 - protein, 38 aa, synthetic construct
RWRLLKRYFRKLNRKLDPFTKNFLYLLSSRKVKKTAAA

SEQ ID NO: 2788 - protein, 41 aa, synthetic construct
KFKWLRKIWRFIKCAYSRRAELALFLYHLKAAVHELARALW

SEQ ID NO: 2789 - protein, 59 aa, synthetic construct
LYKWWRRMFRRLKKRQVVRESVAALAMAGGFLCEHHMKELRRTRHGRFKLLAKHAARLR

SEQ ID NO: 2790 - protein, 21 aa, synthetic construct
FIRILHRLYRRYKKQLLWLAR

SEQ ID NO: 2791 - protein, 35 aa, synthetic construct
LLRWLCKLWRYYQRWLLKIVRPAARDLAICLQNRR

SEQ ID NO: 2792 - protein, 90 aa, synthetic construct
YYKFWKRIIKFMRKLTRKLDATPMRTLLKYELYSRIAHRARTEARAKKIARRALLCKKLMLKNGLDAFDRCGEGSCQKKAQNVLKKALKK

SEQ ID NO: 2793 - protein, 44 aa, synthetic construct
FYKMYQRLLRILSPLKHRACLHIKLVREGKCLRLRKLRKYNRLN

SEQ ID NO: 2794 - protein, 20 aa, synthetic construct
WFRLLTRLFRYLRKQKMLFR

SEQ ID NO: 2795 - protein, 48 aa, synthetic construct
LLKYFRKFLKYMKRKCLRRLVCLLKYFKASLYCTELALLKEKSEAIRW

SEQ ID NO: 2796 - protein, 78 aa, synthetic construct
RFKLFPRWYRRYKPARASARHKAARHPRLLALEARLHVFTSRRMRMKHLSAMELVLACIRKRRKQFRARLRKIRNALA

SEQ ID NO: 2797 - protein, 66 aa, synthetic construct
IFRFLKRYLKRLKKVKNYPDVAKNRTEAFAYRHYILTAGTLVLRLRKIAREKDLKERQARKYALLF

SEQ ID NO: 2798 - protein, 55 aa, synthetic construct
RFRLLRKFFRWLPHCKLAVWAKLKLALLKHWWALCVKFEKGRKDLASRTKPKRYW

SEQ ID NO: 2799 - protein, 39 aa, synthetic construct
LYRFFKKYWRRMKHAKLERLVMLPRAKEWRALVVLWRAT

SEQ ID NO: 2800 - protein, 50 aa, synthetic construct
IYKLLRRLFKWMKKAKKRMARCWRAILSGLLRRANARLLSAMYYRCAHWV

SEQ ID NO: 2801 - protein, 33 aa, synthetic construct
FWRLIRKMFKKMKHKLALMAALLARFAARQLDC

SEQ ID NO: 2802 - protein, 60 aa, synthetic construct
RIKLLKKMLKRFKTMLAYGMLACEAKCELCLGKKFRLITWLPRKRINRRWRIFARAQKYE

SEQ ID NO: 2803 - protein, 28 aa, synthetic construct
KWRFFRKFLRLLQKHSRAKRLALGHLCP

SEQ ID NO: 2804 - protein, 22 aa, synthetic construct
RFRLMNRIFKRFPKRLEAATLA

SEQ ID NO: 2805 - protein, 47 aa, synthetic construct
KIRLFTRLIKFLKKANMRKGAKTRARRPRSLVYSAAHMPLCAMAYKA

SEQ ID NO: 2806 - protein, 29 aa, synthetic construct
FLRLMRRLFKFFKRLSCETDAAGKAKWTA

SEQ ID NO: 2807 - protein, 61 aa, synthetic construct
RYKLIQKIMRLFRTLKWSWTLAHFRGRLLGRLLRERKKKFEQRGWKCEAMLLSKLLKNRNK

SEQ ID NO: 2808 - protein, 71 aa, synthetic construct
RLRWYRRFMRLFCNADLWRTLCHYVVLKTFCKLMCKAKPRHKKLAKLAKNLAMAYDMGARNKHVAAARRKA

SEQ ID NO: 2809 - protein, 61 aa, synthetic construct
FLKLFNKFWRRLRCRLASQLAAKKRAFGMRYARLIIRWGKVRLHIMCKKCFPALDRKALLD

SEQ ID NO: 2810 - protein, 34 aa, synthetic construct
RFRIMRRWYKLLHKGLHKAAKLRYALQKANRKAC

SEQ ID NO: 2811 - protein, 20 aa, synthetic construct
WWRYMKRFFRRLKHLAKMLA

SEQ ID NO: 2812 - protein, 32 aa, synthetic construct
RFKLYHRILRKLKKKARKVLDKANAFYPQSTL

SEQ ID NO: 2813 - protein, 44 aa, synthetic construct
KMKIYRRFMKKFNRHLRGIIRKKALLKAAAAAEKRYKCAAAKHP

SEQ ID NO: 2814 - protein, 32 aa, synthetic construct
KIKLFRRLLKRFRQRRVVAAARALVTNKWLYG

SEQ ID NO: 2815 - protein, 59 aa, synthetic construct
LLKWWNRWLRILRRKAQLMTTKKLLCKALQLPDLQSLNDKAGMREDKGPARLPVLKKKG

SEQ ID NO: 2816 - protein, 48 aa, synthetic construct
LFRLLQKFIRLIHNRKQPKYALKTKRTLFPVKLKIYLAALAHDRLERA

SEQ ID NO: 2817 - protein, 67 aa, synthetic construct
RFRFLKRWMRRYHPMAVAAKRYPWPCPRSRLYKARGFNRKRALLYRAAARLDFLDKLQWAKAMHCIK

SEQ ID NO: 2818 - protein, 38 aa, synthetic construct
KFKLLKRIIKLLRKLKHPHMYLMDIRALRANEFKTKTC

SEQ ID NO: 2819 - protein, 27 aa, synthetic construct
RFKLLSRILRRLNRRYPALLTIRRYYV

SEQ ID NO: 2820 - protein, 54 aa, synthetic construct
RFKFFRKIWRWLRRMLLTPASKNLALLLGLDWLAKFTLRAYNTSYLNNREARRK

SEQ ID NO: 2821 - protein, 48 aa, synthetic construct
KWRFLNRMMKRYRKNLKIAANKTLMDLLYYIIAALSKKAKADKACSKG

SEQ ID NO: 2822 - protein, 33 aa, synthetic construct
KLKYLPRWLKRFNCPMLWAIKFPAAKLKTKRKL

SEQ ID NO: 2823 - protein, 20 aa, synthetic construct
YYRLMTKIYRRLKTTLLLDK

SEQ ID NO: 2824 - protein, 47 aa, synthetic construct
KFRFIRKLYRKFQKAAAHEKFSANKAPKKLCGVLRGSAARLLDFNLA

SEQ ID NO: 2825 - protein, 66 aa, synthetic construct
LFKLINKLLKLLCKICILLYLVLCCAKGEARALKKACHRDIAHAKDHKLYRHHYAIRDLYCKIARK

SEQ ID NO: 2826 - protein, 68 aa, synthetic construct
LLKMFSKLLKLFQQHRCRRALLYERRKWQARLLDHNKHADGSLKERLPKKRANAELKQSLIFAKKKRK

SEQ ID NO: 2827 - protein, 20 aa, synthetic construct
LLKLLKRWIKWWRKRLAVYS

SEQ ID NO: 2828 - protein, 35 aa, synthetic construct
YIKLIRRLIKKIRRMNKTFAAALRPSLLKWHAGAY

SEQ ID NO: 2829 - protein, 40 aa, synthetic construct
FWRFYNRLLKLLRHKAQYYRPIHCLLAARRAKQRVYKSWA

SEQ ID NO: 2830 - protein, 79 aa, synthetic construct
KLRMWKKLFKMYTKPLLRSCRAVHWDAAYAHCHWPKALAQCRQAKKLAAALKRLKTYMVMRKIKLRKYMRMKHRARWLA

SEQ ID NO: 2831 - protein, 37 aa, synthetic construct
YWKFLKRFMKKIRSCTKYAKALKQKALLKSALCPWAN

SEQ ID NO: 2832 - protein, 43 aa, synthetic construct
IIKLINRYLRIIRKLPLWVLEAGRAKAKKAWTGKLRFSMAAKW

SEQ ID NO: 2833 - protein, 61 aa, synthetic construct
KLKFIRKLLRRLKPCLLVWMLAQNLARSMGLYAKREIYRKLLKEGFAVLACLQMTGKQYKK

SEQ ID NO: 2834 - protein, 91 aa, synthetic construct
RYRFYQRLLKYFKKLRPLTGTAMKTAALSKRLQAPGNAFVADKLRPWKRKKIKEIKLKKTFVELHLNMKKKLMQAAYMRRTCCLALILLRK

SEQ ID NO: 2835 - protein, 56 aa, synthetic construct
MLKFLPKFWKRFQKKRDLSAAYELAQKRKRLGLFAHEACGTWCCYATLKRRRRLKL

SEQ ID NO: 2836 - protein, 38 aa, synthetic construct
LYRLFNRFLRRFKKYLRNARAALAGSIKKCQGYKPCKA

SEQ ID NO: 2837 - protein, 41 aa, synthetic construct
RWKMLKKMFRKLCPRANRTDKQLRFATNTLFKLYLLPRKVL

SEQ ID NO: 2838 - protein, 41 aa, synthetic construct
LLRFFHRMWRKMKRDLKCKHWAAHVYLLLLQAKLWRRIRGL

SEQ ID NO: 2839 - protein, 26 aa, synthetic construct
FYKLLRRIIKYFKKAAPALLDYRKKT

SEQ ID NO: 2840 - protein, 48 aa, synthetic construct
KYKILKKWWKLWHKLQRNELRIHKILARANHLFKTLLLALLLKLKKAH

SEQ ID NO: 2841 - protein, 25 aa, synthetic construct
KYRLWKKLIKRLTKGVMIANCLAMR

SEQ ID NO: 2842 - protein, 43 aa, synthetic construct
LLRFFCKIMKRFKTLKKVLLKLLAAHRYSAAEPEPHLYLYRVA

SEQ ID NO: 2843 - protein, 43 aa, synthetic construct
KLKLLRKFLKRWRTEGKQYKYLYLDYAHKILHRIFALKRQKLN

SEQ ID NO: 2844 - protein, 91 aa, synthetic construct
RIRLFKRILRYMPKFRERQKCSTKKARLLAAKKMAEAYLEGAWAASQLKAARLEARSREPIPRAIALNTRFNNRRWAYRFLQLRELAMMAH

SEQ ID NO: 2845 - protein, 41 aa, synthetic construct
KLRYLKKLFRKYHKQARFAHEIKCLCRKNPKAARRLARLGP

SEQ ID NO: 2846 - protein, 29 aa, synthetic construct
LLRFWRKIIRRLRRALEIFGFLMALHRRK

SEQ ID NO: 2847 - protein, 96 aa, synthetic construct
FIKWMRRWLKKINCRREFKARFELLRRMRPRRRTQLKKLCGAKKANLCLRLALPYKRFHHKRRAKATEVNLRLRAFWQLQLPKRRYHALCADRVRA

SEQ ID NO: 2848 - protein, 23 aa, synthetic construct
FFRFLTKLLKRFKQHVKKAGALV

SEQ ID NO: 2849 - protein, 53 aa, synthetic construct
KYRLLPRWLKRMKKRLNLCLKAKGIRLDKQLNRAYYMTCSVYMKHPKATKLAL

SEQ ID NO: 2850 - protein, 60 aa, synthetic construct
WWKMLCRLLKRIRRRWLARMAKSRLLKLQSRSKADLKLARASKAKHIWDRSLKIRLAFLT

SEQ ID NO: 2851 - protein, 49 aa, synthetic construct
KLRFIKKFWRRLRTHLFKARKNAARKGARKLMKLALETNGAKFYMSVYI

SEQ ID NO: 2852 - protein, 40 aa, synthetic construct
MLKLFCRFYRKYRRLKRFRRLMLAILLLLRLQNYFNHLRF

SEQ ID NO: 2853 - protein, 24 aa, synthetic construct
RLKLLKKLFKLLRTTVVRLCYRAC

SEQ ID NO: 2854 - protein, 64 aa, synthetic construct
LIRLFKKMLKMFRPYGRAADARSCLDIADYLLVDWVKARFKGRAGLCLSEAKRANRAAVLRKPK

SEQ ID NO: 2855 - protein, 95 aa, synthetic construct
RLKMLKKYLKKMRTKVKCHRPMIARKPPKRNARAFLARHAAAYKDMEAAKSRHRFMRLIDDRIYKPRRRKIARLILCMDLSRPAERDLKQYSAHL

SEQ ID NO: 2856 - protein, 38 aa, synthetic construct
FLRILQKLFKRLQKKAAKLALMYKRHNLPPWIAFTRAL

SEQ ID NO: 2857 - protein, 86 aa, synthetic construct
IIKFFCKIWKLMTNKMARKRFYLKARASPAALALAMHSAAKKVTVRALHEKRELLVALFRHLLFRFPKYKLALAWGERLNMRLQRE

SEQ ID NO: 2858 - protein, 73 aa, synthetic construct
KLRFWRRWMKLLKPYLYRARGSNQYPKLNLAAKAIWGVKRINVKAVSHRELLDLKLRAVLAKHEKRHVCRALL

SEQ ID NO: 2859 - protein, 23 aa, synthetic construct
YFRFLKKWYKRLKRKILAAVLQW

SEQ ID NO: 2860 - protein, 21 aa, synthetic construct
MLKLLSKFYKRIRRPMGKTAL

SEQ ID NO: 2861 - protein, 25 aa, synthetic construct
LLKMYKRWYKLYNTRIYLKLAKQQR

SEQ ID NO: 2862 - protein, 76 aa, synthetic construct
LIKFLRRWLRKLKTGNRAPMRERDRYRRVAIQCARLTLRALMFTFRAAQFLRKYAAGPAVVDRAKARIARKKYCYR

SEQ ID NO: 2863 - protein, 48 aa, synthetic construct
MYKLLRRFIKRFQPQNYIAADALVFALALKKYFRRKALKARRLKRIFT

SEQ ID NO: 2864 - protein, 35 aa, synthetic construct
LLKLLKKYLKKMKQAIAPNLQESRTALAVKSKLIW

SEQ ID NO: 2865 - protein, 58 aa, synthetic construct
YFKYLSKLLKRWRHAEALYQRAALLDKLKRKDMKQLAHLEFLFHWKLLGATSQDTRKR

SEQ ID NO: 2866 - protein, 24 aa, synthetic construct
FFKLMRRWWRFLKHHQARKAEAAR

SEQ ID NO: 2867 - protein, 42 aa, synthetic construct
KMRLFRKFLRKLRSHFEMWDMQLLRLQQKAASYVLKRLQKAR

SEQ ID NO: 2868 - protein, 64 aa, synthetic construct
YMRLWKRMFKLMRHKRYAMGTPKLKASILLLRIAKNCKRGRRCTGRWDLVRRNAKLAKALRWLQ

SEQ ID NO: 2869 - protein, 28 aa, synthetic construct
ILRLFRKYFKRLRHMYHAKRPAATLWRA

SEQ ID NO: 2870 - protein, 54 aa, synthetic construct
LFRFFRRWLRKLNKRDMKRMTLARALDVKLARQAVSYICKCEQAHRVAASARYL

SEQ ID NO: 2871 - protein, 31 aa, synthetic construct
LLKLITRMLKKYRKIYAHRFAILPLKRELVD

SEQ ID NO: 2872 - protein, 29 aa, synthetic construct
RIRLFRRLLKMFHCDRHATARLKAAADLT

SEQ ID NO: 2873 - protein, 50 aa, synthetic construct
RFRMFRKLYRLICKLALMWAWACTLMRARIERARPALHRKWLCQLNAHWA

SEQ ID NO: 2874 - protein, 29 aa, synthetic construct
LWRWLTKIWKRYQKKDFAILLAMRHRAHK

SEQ ID NO: 2875 - protein, 48 aa, synthetic construct
MLKMYPKLLRFMQKAATLRFKKRNYWDKHAFCIKKSGLERLLKLLPLL

SEQ ID NO: 2876 - protein, 80 aa, synthetic construct
FLKLLRKLYRKFKKKSTLSHLKVEKIDNQCLRLLALDMRYAVLRIKKSKGKAFWACTPLPKLKFAHLANLVPRKMFRRPL

SEQ ID NO: 2877 - protein, 40 aa, synthetic construct
RYRWLRRYLKIFKSEFSIAACYELRATARCRKPKRQLRAV

SEQ ID NO: 2878 - protein, 28 aa, synthetic construct
KFRYWTRLFRRLRTLMHILAAKRLEPRA

SEQ ID NO: 2879 - protein, 79 aa, synthetic construct
WYKLLTRLLKKFKKAHAKKAEALVFDRLKYTQINLKARVAKWNNVFSGRWMAKRSRKAGKRRWLNDSKWTALRKLNVRR

SEQ ID NO: 2880 - protein, 53 aa, synthetic construct
MLKLFTKIMRMYKRRVKKVKCLNTKYLRIMAMEKKPRKTFHLLHHAALLLAAL

SEQ ID NO: 2881 - protein, 37 aa, synthetic construct
LLRYYPKLFKLIKSAPKHSRLFRQLNWKAAYSAAKKK

SEQ ID NO: 2882 - protein, 54 aa, synthetic construct
LYRYLRRWLKLLRRRRAWEWFTYLRTLIMRVKLKGAHCHVFLWLRALREHVNLA

SEQ ID NO: 2883 - protein, 27 aa, synthetic construct
LLRMFKKLFRRFRPAPLFRRHKAQELW

SEQ ID NO: 2884 - protein, 47 aa, synthetic construct
MMKFLRRFFKRLRKQKASLRAKLMKALWDNWMKRTCRSMPTILASKA

SEQ ID NO: 2885 - protein, 29 aa, synthetic construct
KLRIFRKFMRLLTRKNRRFADGLLCLCGF

SEQ ID NO: 2886 - protein, 36 aa, synthetic construct
RIKLFPKLIRMFCCALTSGALALEPKLCKRLAEKFR

SEQ ID NO: 2887 - protein, 22 aa, synthetic construct
YFKFYRKLLRLMNCRRHLRKLL

SEQ ID NO: 2888 - protein, 21 aa, synthetic construct
RLRLMSKLFRRLNKCDQRTNL

SEQ ID NO: 2889 - protein, 43 aa, synthetic construct
LLRIWSRLLKKMRNAKNARPLARSRIRMKGESVYIKRLLNLMQ

SEQ ID NO: 2890 - protein, 35 aa, synthetic construct
KIKFMTKIFRMFRKARLSLKLPASLLRNLAHKFFL

SEQ ID NO: 2891 - protein, 72 aa, synthetic construct
KLRFFNKYFKRIRCMAKLGRKALFAEQYDAKTGPLAKAPVLLKFRRSLQRKNDLKCYDALFMRAWRTKLEKL

SEQ ID NO: 2892 - protein, 32 aa, synthetic construct
IMKFIRKLFKFLQCRVMKKLALRHKLWLCHAR

SEQ ID NO: 2893 - protein, 34 aa, synthetic construct
FFKWLRKIFRLLRKTLRRCLRLVWYKDADRFAGA

SEQ ID NO: 2894 - protein, 29 aa, synthetic construct
LYRLFKRWYRKMKKHALLTRELLKLDKPN

SEQ ID NO: 2895 - protein, 45 aa, synthetic construct
KLKYWKRFFKRWRKYRFAPAYRKVLKKDLGRILFAMLSNLLPWGA

SEQ ID NO: 2896 - protein, 43 aa, synthetic construct
KMRLLPRLIKRFKNKKKFLAPNSLKKLLDWGLLLYRLARYWHL

SEQ ID NO: 2897 - protein, 97 aa, synthetic construct
YLKFMRRWWRRIKKANADFCLYKLRRKLLIAKLHAINALRNKGKSKLRLRELHTYSRRAKRHRMCLACANSDRCCLFLRRLLLIIAIRDMLKVAKND

SEQ ID NO: 2898 - protein, 32 aa, synthetic construct
KFRLFRRLYRRLQHAARFMHPRPKTLAKKALL

SEQ ID NO: 2899 - protein, 45 aa, synthetic construct
RLKFFRKWLRRWCSLLIRILFRLPRLRWKLKLGPKKRACMVWSFL

SEQ ID NO: 2900 - protein, 32 aa, synthetic construct
IMRLYNRIFRYLPKLTLKVLALKLARKKKLLS

SEQ ID NO: 2901 - protein, 44 aa, synthetic construct
ILKLLHKMFKRLNRTKLKALALQIAIQCARDQAVKCNLKKKMRD

SEQ ID NO: 2902 - protein, 57 aa, synthetic construct
KIRLLKKMFKLFCTTALRLILKRWRQRLQATWRWILLEGNACAYRKLWLREAAATRY

SEQ ID NO: 2903 - protein, 31 aa, synthetic construct
WLRFYKRLYRILHKRAQVSVYSLKRALALAK

SEQ ID NO: 2904 - protein, 62 aa, synthetic construct
KLRMLRRFWRRFRPAELANLLRRMLLRQLAWLHKDHTLQAMKQYVLKTKRLLKLTVKLAMYK

SEQ ID NO: 2905 - protein, 56 aa, synthetic construct
RLKLLRKFLRKLHKRVAALSEVMDKFTLAKARAKSDKRGRIATDSFETMKHLRAFR

SEQ ID NO: 2906 - protein, 62 aa, synthetic construct
FLKLIKKLMKRYRKNVAAQEFRLKLKKGRRLMLARRAVRKVHHLDMLDKGLAIWAPLGAARL

SEQ ID NO: 2907 - protein, 31 aa, synthetic construct
KLKFLSRWFRKLNRPAMHAKLRADGFKLQAH

SEQ ID NO: 2908 - protein, 40 aa, synthetic construct
FFRWIRKLLKRLSHLKALVNFRRILTALRENALKKAYISA

SEQ ID NO: 2909 - protein, 23 aa, synthetic construct
RFKFLTKLLRLFKKIKSYNFAYA

SEQ ID NO: 2910 - protein, 20 aa, synthetic construct
WFRWLRKFLRLMKNNRACML

SEQ ID NO: 2911 - protein, 27 aa, synthetic construct
LLKLLRRFFKKIKRKQAEKLGVNADVA

SEQ ID NO: 2912 - protein, 31 aa, synthetic construct
YLRLWRKLLRRYKKDHRAKYPDLAHIIKLRS

SEQ ID NO: 2913 - protein, 59 aa, synthetic construct
LWKYMPRLMRLWRKPKAEFKLCLLKNMANKAFEQGKRHRKKARWGSLLLRKYAANALGR

SEQ ID NO: 2914 - protein, 22 aa, synthetic construct
LFRFWCKLFRRFTTKLKLLLAA

SEQ ID NO: 2915 - protein, 47 aa, synthetic construct
KFKLMKKLFKRIQKVHLGLKLGEELECRLLAKASRRWAGLRCARGCR

SEQ ID NO: 2916 - protein, 75 aa, synthetic construct
RIKLMRRYIRKLPKQGTRKKTATAALQLAARLLAHDKFRLACPLGYLRERDNKTQRFAMKTKARLKASRREDDNA

SEQ ID NO: 2917 - protein, 28 aa, synthetic construct
LFKFLKRLFKKLHNLAYRLRRLKKHELE

SEQ ID NO: 2918 - protein, 40 aa, synthetic construct
MLKLLCRLFKRFKKRQAALEALDRRDRYTRLHRKHPLCCM

SEQ ID NO: 2919 - protein, 33 aa, synthetic construct
RIKWWKKMLKKLSKVRAALMQALKYLKKWPIRA

SEQ ID NO: 2920 - protein, 61 aa, synthetic construct
KYKLFQRLIKRMTKKGLKRALAPSKKMGLPFRNPLLAYACAREAKVLNRLVMEFKAGAPLL

SEQ ID NO: 2921 - protein, 64 aa, synthetic construct
FLKFIQRILKRWKCQLLCSDARKAAAAKARSLKCACWQYKWKGRLYRASALCKAYKAQRNDKLF

SEQ ID NO: 2922 - protein, 54 aa, synthetic construct
RFRILKKFLKRMKQQRKQFLTNWRAPLTGHLFRAKILRPGRLLLLKDHLATDKR

SEQ ID NO: 2923 - protein, 36 aa, synthetic construct
RMKWYQRFLRKIHPHALLDNKDWKALLRKLCKRTKL

SEQ ID NO: 2924 - protein, 39 aa, synthetic construct
KLRYYKKLFRKLRRLRCGLKKHIAAMLYETNGAMIAVKT

SEQ ID NO: 2925 - protein, 29 aa, synthetic construct
RMRMLTKFIRFYRRARLAADRLAERRACL

SEQ ID NO: 2926 - protein, 46 aa, synthetic construct
IMKFMRRIIRYIRKLLLRRARSMMTMKHGLMLLPLQAARKLLKAIA

SEQ ID NO: 2927 - protein, 27 aa, synthetic construct
KIKLLHRLLKFIRKRISVAERGLARRL

SEQ ID NO: 2928 - protein, 25 aa, synthetic construct
LFRIMKKFYRLLPRLKELKCLMSKH

SEQ ID NO: 2929 - protein, 49 aa, synthetic construct
KLKLLKRMLKLYRRKSRNWNAWLSYMKMPLPLADLLRKAQIRLGFFTNK

SEQ ID NO: 2930 - protein, 23 aa, synthetic construct
LLKFMSKLFRLLRRTEVKPRKLF

SEQ ID NO: 2931 - protein, 20 aa, synthetic construct
MMRLYHRLFKKMRTWALLNR

SEQ ID NO: 2932 - protein, 25 aa, synthetic construct
LWKMLCRYYKRLRKLRWVANVWKAP

SEQ ID NO: 2933 - protein, 29 aa, synthetic construct
MLKMFKRYWRLIRSRAYWPARLRALVYRD

SEQ ID NO: 2934 - protein, 40 aa, synthetic construct
RIKWMCKYLKYMRRKQLLLADQRRLLLKLKEAKATSKIPC

SEQ ID NO: 2935 - protein, 20 aa, synthetic construct
RLRLLRRIFRYYRRNLMNDL

SEQ ID NO: 2936 - protein, 82 aa, synthetic construct
LWRLFRRWLKRMRKAKKKLARKNCRCKCAQRPRMHIHNRRARFAPMRKYPKDWVKYTWAKARYTHRQLAARARCTLLCAAAV

SEQ ID NO: 2937 - protein, 28 aa, synthetic construct
WLRFIRRLYRKLKRRMLLSIELKLAHVF

SEQ ID NO: 2938 - protein, 83 aa, synthetic construct
LLRFFSRLLKRLNRKLLGARAEASTAHQKSYGNEVFARAARRLLWRRLAVRKLKENETTAMAYWSCPLYAKKAMYECCALRVR

SEQ ID NO: 2939 - protein, 27 aa, synthetic construct
FLKLLKKYIKRMRNWAFMALVFVKRAT

SEQ ID NO: 2940 - protein, 70 aa, synthetic construct
RFRILCRWWRLFTRKRAALEIANHLWYAKYERKRHRQRRLARWRECFKRLSNLRKPRKRPLLYLTDLPMF

SEQ ID NO: 2941 - protein, 24 aa, synthetic construct
LYRFMTKLIRLLKTNPAAILAIRR

SEQ ID NO: 2942 - protein, 20 aa, synthetic construct
KLKILTKWIKILPRPLAPKF

SEQ ID NO: 2943 - protein, 24 aa, synthetic construct
RFKFFQRLMRLLHKVYKALTLRVA

SEQ ID NO: 2944 - protein, 23 aa, synthetic construct
RYKLLHRWFRKMPRCLLAREMAK

SEQ ID NO: 2945 - protein, 50 aa, synthetic construct
FFRLICKFLKRYPKKHCALKKDALILLKGKAKLNKSACAKQVLPARWYPR

SEQ ID NO: 2946 - protein, 31 aa, synthetic construct
KMRLWKRILRRLRRAKLAYCNKTEMHLACRL

SEQ ID NO: 2947 - protein, 43 aa, synthetic construct
RLKLWRRFFKKLKRAVADFRKMRTRVLFCTRWLTLAAIYWKSG

SEQ ID NO: 2948 - protein, 81 aa, synthetic construct
WFKLWRRFLRWLKRKKGMVAKLAATQRLHAQACHEERLQVCKLAREKADIGRRREKTLKWLPEKAMLCRRYRAAIKASFGL

SEQ ID NO: 2949 - protein, 32 aa, synthetic construct
YLRWFRRLLKYIQKAVYKALKALGKTLGLERK

SEQ ID NO: 2950 - protein, 40 aa, synthetic construct
YFRMLKKYIKFLRKAAVAKHLAALRLIHLKVLMRVGLRRL

SEQ ID NO: 2951 - protein, 22 aa, synthetic construct
RYRLMTKLIRRLRQRSPTASAA

SEQ ID NO: 2952 - protein, 28 aa, synthetic construct
RFKFMKKILKYLKKLKTRLWAKKALAGA

SEQ ID NO: 2953 - protein, 36 aa, synthetic construct
LYRLFQKLLRKMQKRRLCAAHQYRADFKLEILDPQR

SEQ ID NO: 2954 - protein, 32 aa, synthetic construct
FLKLFRKLLRMLSKNTLKKRALKKAWRWKYDM

SEQ ID NO: 2955 - protein, 35 aa, synthetic construct
KIKLLTKLWRLLKRIFKRLAFCRCAAHNESAILLK

SEQ ID NO: 2956 - protein, 45 aa, synthetic construct
LWRLMCRLIKRIHRCDLVRKRNLPLLLLQKLHDLAHDHLKRLAMH

SEQ ID NO: 2957 - protein, 77 aa, synthetic construct
LLRWLQRFMRRLRKKLRRTKLRKCIEKCDPCRAILAPNAKACTYKNDSKAFDRARTDVQLGQLAPMLVVKRALAAAV

SEQ ID NO: 2958 - protein, 26 aa, synthetic construct
KLRFLKRYFKKFPRLAVLADAAQQKT

SEQ ID NO: 2959 - protein, 54 aa, synthetic construct
RFRFFQKILRKIKHLLLLAAMKNKDDLLQDKFATKMKHDGLAARLLRVAVNSLM

SEQ ID NO: 2960 - protein, 24 aa, synthetic construct
LLKMFRKLFRMLKRLPDALTQACE

SEQ ID NO: 2961 - protein, 37 aa, synthetic construct
KMRLMCKILRLLTTAHIRLLRSKINRYRELAYALKKA

SEQ ID NO: 2962 - protein, 69 aa, synthetic construct
WLKFLKRLLRRFRHLKSPPRHIGRRQDHAMMLSLRKKVLWNELYLYENGWMALKKLILRLCKCAKLRWA

SEQ ID NO: 2963 - protein, 35 aa, synthetic construct
RFKWLCKLWKLLKQAKAYSAVKREAYCWLKVKLLE

SEQ ID NO: 2964 - protein, 22 aa, synthetic construct
LFRLMRKLWRLLNRLKLNIAKA

SEQ ID NO: 2965 - protein, 96 aa, synthetic construct
RMKIYRKLLKYIRKLARKIERQCHKNAFLPEQLGAPKLKNYPIMALRAWAADIFKRPERKRKSKRLDSRKRWYLIAAAFCRKNSSLRARAMWLLHR

SEQ ID NO: 2966 - protein, 21 aa, synthetic construct
KYRFYRRLWKKFRQQLVALAI

SEQ ID NO: 2967 - protein, 38 aa, synthetic construct
RLRFYQKFMRRLRHKLARWTWALRMRWLKSKAQLAVRM

SEQ ID NO: 2968 - protein, 50 aa, synthetic construct
RLKILRRFMKFLRSIACQKEFAAERKRNLLHPLADERKIRIARAAARTAM

SEQ ID NO: 2969 - protein, 36 aa, synthetic construct
RWKLIQKLMKRWQPKLLAELWRAANPLATPKARQRK

SEQ ID NO: 2970 - protein, 54 aa, synthetic construct
LIKYFNRLFKKMRNRRRGYAILRAALNQNAMKKKAFLKWCCFMLALCSLNFARR

SEQ ID NO: 2971 - protein, 94 aa, synthetic construct
RFRMLHRILRLLRKMRKAHHNNLYQERRKGKQRFMCDCALSAARCKGMLNMYTLKYKPTRKARVKLLCCLVKKEKAKKMAAAGAKYGDLLRTHR

SEQ ID NO: 2972 - protein, 96 aa, synthetic construct
RFRLIKKFFKKFKSDATLAIGKLRRALAMVKRKLNRIWYARYPRVCSKELKFLCMAIIKLKVTAETWDAAVKAPALRLLVKKYREMLARMAHGARG

SEQ ID NO: 2973 - protein, 41 aa, synthetic construct
KMRFLPKYMRRLQNQRKKRIVPALLKCCAADSWLAKKMELR

SEQ ID NO: 2974 - protein, 49 aa, synthetic construct
YFKILRRLLKRMNRSADAQASSKAARKHRKWELSAKKWARYQLCSSMTL

SEQ ID NO: 2975 - protein, 66 aa, synthetic construct
KMKYLRRWIKKLCSREDLNLNPLRRMLLLLRFKGKAITYASWGAPRLAIATSKPRAPAAKAKYFWL

SEQ ID NO: 2976 - protein, 26 aa, synthetic construct
LLRFFNRWIKYLNTLKWILKFRRAAK

SEQ ID NO: 2977 - protein, 22 aa, synthetic construct
FLRLIQRMLKKYKSKLKLCVLN

SEQ ID NO: 2978 - protein, 22 aa, synthetic construct
RLKLLKRLIKLFNKLCKLPDKR

SEQ ID NO: 2979 - protein, 25 aa, synthetic construct
LFKFLHRMLRRLKRMKTGYAAKKAT

SEQ ID NO: 2980 - protein, 56 aa, synthetic construct
KIKWFPKMYRFWRKEKCAKRHLKQLRKSLLRLEAMPQMLADLLQENHKRTARKAMA

SEQ ID NO: 2981 - protein, 32 aa, synthetic construct
RWKLIKRLLKRYTRRYAGAKEACCDGARAARR

SEQ ID NO: 2982 - protein, 25 aa, synthetic construct
RLKWLPKWYKRLRRKYLKLWALFLW

SEQ ID NO: 2983 - protein, 94 aa, synthetic construct
RLKLLQKWMKKLRKLEMSIAAPLACEGDLIHCQKAHSYLIKDILVRLHRIFRGRRHLKALMRLLKLRNRCARKKQAAVETKCSKDKQATVKKDR

SEQ ID NO: 2984 - protein, 80 aa, synthetic construct
LFKLWPKLLKRLRRNFKQHRRHFKFKFSWKYLCLCTKLAFMSTLMRLCLWKKLKKAAGALRDYCKKPASRKLMRFAFRKK

SEQ ID NO: 2985 - protein, 26 aa, synthetic construct
RLKLFRKLLKLFQHARWLKQKQGRPD

SEQ ID NO: 2986 - protein, 73 aa, synthetic construct
KWRFLRKLLKFLRKKLPCKRKAVIRAQACARHKKCWAWLIKAPNDRVADLRYDLWTVRIRNLAALYQKKKPIR

SEQ ID NO: 2987 - protein, 41 aa, synthetic construct
LYRLMKRWYRKLKHHLAKAARFRALYTSLRATHKHVVLREL

SEQ ID NO: 2988 - protein, 50 aa, synthetic construct
FIRYLPKWWKYWTKPQLLRAKKRPLNKRRARVLTLAAIFKLKTNARSSAS

SEQ ID NO: 2989 - protein, 56 aa, synthetic construct
FFKYFCKLMRRLRRWEFKQFLKNRDLKRRKQYLARGKCPSAERTKLFHAAIAALPL

SEQ ID NO: 2990 - protein, 54 aa, synthetic construct
LWRWLKRWLKRYNKPKLEDWHFATRWAWLAKRCMKGKRRYRQLVRLRGRLLELG

SEQ ID NO: 2991 - protein, 42 aa, synthetic construct
FMRMYHKWLKRLKKIKPASQAVERLKARYLRAVADHKKSLLN

SEQ ID NO: 2992 - protein, 42 aa, synthetic construct
RLRFLRKMLKWLCRDKLLIKRAHVTQKKLLAVLNMAGKRAAA

SEQ ID NO: 2993 - protein, 71 aa, synthetic construct
RMKLLQKIWKRLPRKRMKNMRLKFHLKDKKKCALVLRRFKALRLEKAYAVCSAIWGRKERLSANRALRECT

SEQ ID NO: 2994 - protein, 37 aa, synthetic construct
LMKLFNKFMKLYCKKKLNLLEMRRLAKRAIMIHAAKL

SEQ ID NO: 2995 - protein, 24 aa, synthetic construct
WLRWLKRFFRFLQKLLHARKVRQP

SEQ ID NO: 2996 - protein, 36 aa, synthetic construct
RFKLLKKYLRIFTCLEAALLGKTKFRRVPANKAIEQ

SEQ ID NO: 2997 - protein, 36 aa, synthetic construct
FLKWLKKMIRLLKRKALAYKMDRAKKILKHDLWVKS

SEQ ID NO: 2998 - protein, 50 aa, synthetic construct
LLRFWKRLYRKLPNALCDWCTLLKAKGAKAVLIKRFRHLHAKVNRERNKN

SEQ ID NO: 2999 - protein, 43 aa, synthetic construct
ILRYLKKYFRKLRNWKRSANRCLRYIQARLCLARGGDLEHHRL

SEQ ID NO: 3000 - protein, 27 aa, synthetic construct
LWKILKKYLKRLPNVKPEKLLLCKLAL

SEQ ID NO: 3001 - protein, 45 aa, synthetic construct
KIKLLKKLLRRFSSPAQRAGIHQKKICDYTRLGNKLSKARAACLM

SEQ ID NO: 3002 - protein, 28 aa, synthetic construct
LLRLLRRLMRKWRRLSRHANMRARYDPA

SEQ ID NO: 3003 - protein, 42 aa, synthetic construct
FLRLLRRMIRRFKRHYMAFAALVRWVWHLREAKALLLNGYRT

SEQ ID NO: 3004 - protein, 83 aa, synthetic construct
RFKMWQKLMRRWRCKRRIAALWKRAYKRKYKDRLKKRNQLRAPRSAIMRFQALMLRLYLGQVQLENSARKTHLMLTFRRALYN

SEQ ID NO: 3005 - protein, 90 aa, synthetic construct
FIRFLKRLLKKLRRCRLYLYAHRRRYVNLRKTDIKAKTKFAPTAKALLQKLKAACRIYMGFKKLIRLLLAGLWFAVHKKRFASRKLRLYR

SEQ ID NO: 3006 - protein, 63 aa, synthetic construct
FLKLFKKLWRKFSRRREELPPTRQFPIAPKLHLRRMICKAYARKEKCATLEDAARLARSRLLI

SEQ ID NO: 3007 - protein, 77 aa, synthetic construct
RWKFWCKFYKRYKRRADKRKAKLLLASMKKAKRANYKSAKFKLPVAYCVALIRTLCIAANLQTTSHALRFDCRFYRR

SEQ ID NO: 3008 - protein, 24 aa, synthetic construct
IIRILKKLWKKLRPRATMRLLRCA

SEQ ID NO: 3009 - protein, 33 aa, synthetic construct
LLRYLCKWLKRISTLKLRIRRLFGNDAAPMLPL

SEQ ID NO: 3010 - protein, 34 aa, synthetic construct
WFKILNRFLRRYRKLKRLLRAWRAAMRLEAKLRG

SEQ ID NO: 3011 - protein, 36 aa, synthetic construct
KWKMFHRIFRRLKRGKQLKLEGLAARLQTLFFKDAP

SEQ ID NO: 3012 - protein, 20 aa, synthetic construct
RLKWLTKFLRMYNHRRLDLR

SEQ ID NO: 3013 - protein, 42 aa, synthetic construct
KWRFISKWFRRYRRFKLLKDAAHDVTLLAHTLRRKAMRHAKV

SEQ ID NO: 3014 - protein, 28 aa, synthetic construct
LLKLFRRLLRKYHCCAKKLTWTDARKAL

SEQ ID NO: 3015 - protein, 33 aa, synthetic construct
RLRLFNKWLRKLTHARINDVEAAKRKKLKEGAG

SEQ ID NO: 3016 - protein, 62 aa, synthetic construct
RYRFLRRYLRKLQRHRMVRAHLAFQMKRKPKQKKELRGLMGVLLYCELWTHARLYAAKIKIL

SEQ ID NO: 3017 - protein, 54 aa, synthetic construct
MLKYLKRLIKWLHCQPFGASLWKHRKKIARLAHKPKKACMKATRANLGKAANKR

SEQ ID NO: 3018 - protein, 33 aa, synthetic construct
RYRLWRKYLRILRQKGLYMKRATAPLALAATKL

SEQ ID NO: 3019 - protein, 28 aa, synthetic construct
KFRLLKKFFRRMHCAVVKLLQLQVLTRK

SEQ ID NO: 3020 - protein, 89 aa, synthetic construct
RLKFFTRILKKFQTMLPLAQRHRLLCYRKVARAECLEEKLNVKCKERLQDAWRQRYKKLLCRLGKKLLFNFKSCDLHKAVLICKLTAAK

SEQ ID NO: 3021 - protein, 47 aa, synthetic construct
WIRLLCKFFKKLHCSEEAKAIAASRLRKQKYRRCAFLLLFRDGQARS

SEQ ID NO: 3022 - protein, 44 aa, synthetic construct
LIRLLQKLYRRLKHAKFWRKQPHHAQRAVKVLIMLKEAKGLHWL

SEQ ID NO: 3023 - protein, 32 aa, synthetic construct
RFRLITKLLKRLKRKACKRRNLKDAVLTIAGC

SEQ ID NO: 3024 - protein, 51 aa, synthetic construct
RWKILRKFLRKLRQLNAMLYAALNWNCMKADLSNARLRAEKEYGLLKIEIR

SEQ ID NO: 3025 - protein, 49 aa, synthetic construct
KLKFFRRLMKLLRNQWTLALKRYKHDLKVPRKHKQPLGLLMQGREYAGL

SEQ ID NO: 3026 - protein, 76 aa, synthetic construct
RIRLIQRLIRRMRQLALLIADKNQAIGLAKHRAAFLHLRLKKSLLGRFTASKPGGAEVISVWANAKARLRLMGKVW

SEQ ID NO: 3027 - protein, 93 aa, synthetic construct
KFKWLTKLLKMMRRKKMILMACLNQYRAMPWLARYRLELLKLADGYFNPKKRAASQAEHKRADPWLRPGAALAWLFRLKVRHLAVNKKACKNW

SEQ ID NO: 3028 - protein, 48 aa, synthetic construct
RFKLLRKFLKKYQRANLEFAKVWRWRNKRKQRWREASAALVPLHIAKV

SEQ ID NO: 3029 - protein, 81 aa, synthetic construct
KWRFIQRLWKLFPKMDRHNKLRGWLTGAYKLNLLAKLDRAWNKMILIVRLVRRAPKLVVRAIYKLATAYLKLALPWDRLAK

SEQ ID NO: 3030 - protein, 32 aa, synthetic construct
LIKIYKKLWKILRRCRLEKGFALPGKAAELSI

SEQ ID NO: 3031 - protein, 26 aa, synthetic construct
FYRWMRRLYRKIRRQLKAIAAHALRM

SEQ ID NO: 3032 - protein, 40 aa, synthetic construct
KLKFIHKLWRRFKKHTCAWKKAAVLPLKLCHVKLSKKVSE

SEQ ID NO: 3033 - protein, 98 aa, synthetic construct
KWRLLKRFIRLMCKRLLRPLRAWWDRMMLFKKRKHSAVWHANAHQRKRKPVRLKRYYRRKVLLRFLSFAVLRKENNEGMILFAAQLKFFCLSLRTRAC

SEQ ID NO: 3034 - protein, 28 aa, synthetic construct
RFKMLRRILKFLQRLRKSCLALKADSWN

SEQ ID NO: 3035 - protein, 25 aa, synthetic construct
LIRLMRRFYRLFNHLRKQAVASPRA

SEQ ID NO: 3036 - protein, 40 aa, synthetic construct
IFRFYQRLLRRMKSCQHSLAKEIYTECLKRLRKRARAKLL

SEQ ID NO: 3037 - protein, 70 aa, synthetic construct
YFRLLSRYLKMFRKKVRKLAALHALSLAKAIKCYFLLANCRVMLKCAEATKGAAKPKHTGAPWIRLVWRR

SEQ ID NO: 3038 - protein, 27 aa, synthetic construct
KMRLYQRMLKRYKKLLMGGLWRADVLA

SEQ ID NO: 3039 - protein, 59 aa, synthetic construct
KLKFLRKYIRKFTRAKSKRARAQRYWATFLNRMRHATWALEQEKLRRVAARNKVKLHLY

SEQ ID NO: 3040 - protein, 46 aa, synthetic construct
FLKLFKKYMRRWRRRGWRYAIYAGLRAALVLPIRKPQRKWVAKHLW

SEQ ID NO: 3041 - protein, 21 aa, synthetic construct
MLKYFQKWLRRFKKTALYAFR

SEQ ID NO: 3042 - protein, 61 aa, synthetic construct
LFRLLRRLFRRFKRQHLQAHYWAWWLAAKIRMGWCKARFKKKLALLRVRERCAAYLAKHPA

SEQ ID NO: 3043 - protein, 30 aa, synthetic construct
RLRLWRRLWKLWHPGRNKQKAKAHKALNSC

SEQ ID NO: 3044 - protein, 39 aa, synthetic construct
LLRIFTRWLKRFKKPLAAAAALLRVSHLLHMKRMHKKLP

SEQ ID NO: 3045 - protein, 54 aa, synthetic construct
LLRWLRKLLKLYQKHQKSELYLSRLFFKKVRMRRYLQQEKRWGLPARRMIILCK

SEQ ID NO: 3046 - protein, 50 aa, synthetic construct
KFRFFKRLFKKLRNFQAAAWLMKETAQKEALCKLKNCLIKSIWLKHLLRA

SEQ ID NO: 3047 - protein, 39 aa, synthetic construct
MWRLWSKLLRKFHKKRVRWAALSCLLRAKNKKIYSEKHA

SEQ ID NO: 3048 - protein, 21 aa, synthetic construct
YLKMWNKMYKLYKRRRHAALL

SEQ ID NO: 3049 - protein, 99 aa, synthetic construct
KLRMICKLLRFLRQMRRLRVGDGACRKLMLLQLKWKCKPNPRWLAQLRANRLELEALLLALGLILRLERRFNKCWLKAAVTVYRMYLRKPRYLRRRHVM

SEQ ID NO: 3050 - protein, 78 aa, synthetic construct
KWRFLRKLYRRYRKPARYVKNLAAFATRRKRRMAGRLAMFYPQRKANFPGRRGSIAAIRIAKERFVAATRSFEQLKLW

SEQ ID NO: 3051 - protein, 41 aa, synthetic construct
LMRLYKRIYRKYRKAAAKIVAEKVYTSPKDLRKLALLPMAS

SEQ ID NO: 3052 - protein, 29 aa, synthetic construct
RLKLWKKFWRIFSHDKLHLDLPYLRTAAR

SEQ ID NO: 3053 - protein, 38 aa, synthetic construct
KLRYFRRLLRLFCKSPRADNKRLSPPGLCRVGSRPARL

SEQ ID NO: 3054 - protein, 36 aa, synthetic construct
KLKLFKKWLRKMRRLIFADTLLPTRDKQKAHALNTK

SEQ ID NO: 3055 - protein, 50 aa, synthetic construct
KYKLFKKLLRWWKKGLVRLDLLLKLRATLAWLKYAMKPCRSPLAAAKQSG

SEQ ID NO: 3056 - protein, 38 aa, synthetic construct
LYKFLSKFWRLYTKLHHNDARNGKLRPANKLMLKKAAL

SEQ ID NO: 3057 - protein, 40 aa, synthetic construct
FLRMLNRLYKYIRSKWARDAFTKRWRKKMLIAAHKIMKEL

SEQ ID NO: 3058 - protein, 26 aa, synthetic construct
KFKILQKLWRRLRRAEAVAFATKEML

SEQ ID NO: 3059 - protein, 78 aa, synthetic construct
MFKIINKLYKYLHQACKPLRLHRPIKLRSRMARYSAWATVLEAWRARLLIRSAALKAMMMPRARPKGRRRRRQHGARQ

SEQ ID NO: 3060 - protein, 45 aa, synthetic construct
KLRLMHKLWRKLRCHGFVATAHTLKCEARLAKIKLLRRAALCRYA

SEQ ID NO: 3061 - protein, 66 aa, synthetic construct
FFKWLHKYLRYFRRLKKKYLDALLLRHNKRAWFLFLLFNTGIAKHAFLNLLARRKKQGRLMLGAGG

SEQ ID NO: 3062 - protein, 65 aa, synthetic construct
LLKFYKKILRLWHRRAMAHVIDAKLPRKKAIRWDTARLAPKYDKLANELKSKATRTLEATLRAKG

SEQ ID NO: 3063 - protein, 29 aa, synthetic construct
MIKYLSKFIKKWKRNAKIIAKAAIDARLL

SEQ ID NO: 3064 - protein, 22 aa, synthetic construct
FLKLLRKMLKLMRKIGIPAIRR

SEQ ID NO: 3065 - protein, 36 aa, synthetic construct
LLKLIKKYLKFLRHNTKHLLLLGTRRYYAQRVLRYL

SEQ ID NO: 3066 - protein, 43 aa, synthetic construct
RIRFFKRMLKKYKRAHDARDYALKSPAAFRNLYFYAKDKRALR

SEQ ID NO: 3067 - protein, 43 aa, synthetic construct
RWKLYKKLWRRFTRQGWKFRKQERLNCMGLCLRLRLKLNWCLA

SEQ ID NO: 3068 - protein, 30 aa, synthetic construct
RYRLLKKFMRLWNKCVLYLKLANLHKAEIK

SEQ ID NO: 3069 - protein, 43 aa, synthetic construct
MWKLFQKLLKLYRRRKLMYMFKLRRDKQFLKRLWALARHKKLG

SEQ ID NO: 3070 - protein, 40 aa, synthetic construct
KLRLLKRLLKFFKSFLRNACAGAAARQRRTMGQDKATTKI

SEQ ID NO: 3071 - protein, 45 aa, synthetic construct
RWKLFKKFLKRFRRARSIAAALKLARAIWKVKWVRAKAKSLSHIF

SEQ ID NO: 3072 - protein, 39 aa, synthetic construct
RLRFMPRLLRRFKKRTVLLAALWDQKYNDYKPRRLQVAD

SEQ ID NO: 3073 - protein, 56 aa, synthetic construct
WYRWLRKLWKRLRKQLDWRTKNVWFKLSAASAAGRDRPLKLALYACWYRKKMRAWK

SEQ ID NO: 3074 - protein, 78 aa, synthetic construct
RLKLFKRFLKKYKHKSKVTINRILRTCAANWAAKARRKRQPACLEMSKRFLAAWLKRARAKLKAMIACGKAMRTAKMH

SEQ ID NO: 3075 - protein, 42 aa, synthetic construct
KLRFYKRIWKLLKKPFASCCLPNQLLRRQFNQANKARAACAL

SEQ ID NO: 3076 - protein, 26 aa, synthetic construct
KLRWFKKWFRLFQRLDPILVAAILKK

SEQ ID NO: 3077 - protein, 42 aa, synthetic construct
RYRFLKKFLKKLRPQLVKDKMKWLCNAKKLKAGVACRDLQRA

SEQ ID NO: 3078 - protein, 68 aa, synthetic construct
ILKLIKRMFKFLCNRKADLKRATKVLRCKALPRKAQDSYRLAWAWARAKKEALQQQYALHQFLKLRQY

SEQ ID NO: 3079 - protein, 43 aa, synthetic construct
ILKFLQRLYKRLHHGTPTMKRAKYRARLRELAEKCILGCKLIA

SEQ ID NO: 3080 - protein, 32 aa, synthetic construct
FYKFYRKMLKLIKRNKRRLGALLKRAHYMNQA

SEQ ID NO: 3081 - protein, 22 aa, synthetic construct
WLKMLHKFFKRLKRALSMCRPL

SEQ ID NO: 3082 - protein, 90 aa, synthetic construct
RWKYLSKLIRRFRQIAGLVKRLRMRDKIICLRDYARNNASAICKLLAGLHALMAAMLYQAARARFREPKWRYQRNAGLLAKTPRDRRFGA

SEQ ID NO: 3083 - protein, 81 aa, synthetic construct
KIKLLKKLLRRICKINNHAKKYDNFKPTRTLKQRLKCMKKFDLVLASTAMCNGMAWAMGHQDHRRGALLRKAARQLAARAK

SEQ ID NO: 3084 - protein, 63 aa, synthetic construct
WWRMYKRLLKMLHSRIWQLNAALRRPAYALCKRSFAAGKFRLMEWHAEKEHRKMRRLKKAGER

SEQ ID NO: 3085 - protein, 50 aa, synthetic construct
KLKMFSRYMRRFRTRPLRLLPLQLHAYRMIWMCMRKAKLPRIAALKDKRV

SEQ ID NO: 3086 - protein, 52 aa, synthetic construct
WFKYMKKFLKKLQNKGLRLIMEILRWKSMAKGLRLAFYICRKARASAAATAW

SEQ ID NO: 3087 - protein, 71 aa, synthetic construct
YWRFFSRIWRRLRPCRNLYAGLKEKLNLANAECDAFDKWPFIRKRLAKRKIKAAKLKRLDERFDAPRALRR

SEQ ID NO: 3088 - protein, 55 aa, synthetic construct
FLKMYPKMYRIWRRVCRQFMLRTAAQREAKLLAPARNRYPMAALALWKRLLLAKK

SEQ ID NO: 3089 - protein, 70 aa, synthetic construct
KMKWLKKFLRFYRKNEKLAQRKRRLFLRPKGAVKELCDKLATLRVSEMRCACAKAYKRKLKLLHENHLSL

SEQ ID NO: 3090 - protein, 22 aa, synthetic construct
RMRLWTRILKMYKKNAKLGAQA

SEQ ID NO: 3091 - protein, 66 aa, synthetic construct
RFKFLRRMIKLLQPCLRRRLYGKARCLCHKAPIKLGLKDRGANARKKALPACAFSAQMGQKHRRFR

SEQ ID NO: 3092 - protein, 55 aa, synthetic construct
KYKLMRRLLKWMKTMKRAWSRAEWRKYRLTAALHVRLFKRKRSWPEYLNKEANLA

SEQ ID NO: 3093 - protein, 32 aa, synthetic construct
FFRLFKKFYKWYHKLLVAKKSERLMPKLDARL

SEQ ID NO: 3094 - protein, 49 aa, synthetic construct
MLKFYRRLIRRLNREAPRERILAEFKERAWRCRRFAALLCALNLSKNAT

SEQ ID NO: 3095 - protein, 43 aa, synthetic construct
RYRLMPRWYKMFQTACLPLLEVRTSRRRLLVLLALKKRCRTLR

SEQ ID NO: 3096 - protein, 56 aa, synthetic construct
LFRIFQRLFKRLQHSRAMRFSRRKYKYHRMLFRDELNRRLLDLLLRHVTKALKPKQ

SEQ ID NO: 3097 - protein, 68 aa, synthetic construct
KIKWFKKIFRYLTKHLRLLKWLKRVWKERKPMLFDLAKSRAANQYWALRSQQKAAIRLRAYAKKIKYM

SEQ ID NO: 3098 - protein, 70 aa, synthetic construct
WLKFLSRLLKKMSRAAADMWKRQNSMRRTLIKYAKGKKYSAIWRALRKRDRLKAMWLCFLRIKSVPKGDK

SEQ ID NO: 3099 - protein, 83 aa, synthetic construct
KLRIMKRLMKRITHAKKKMRALVQLKCIQLLRNFACRKRRLNNMHFKIDRPAARAPLPQNRALSLLRVLNPKVQKRGWLKAPM

SEQ ID NO: 3100 - protein, 86 aa, synthetic construct
KLRFYKRFYKILKPTRVGVAKYLAYKAYALADKASRCPRAKRRKPTTALLRNQRKIKASADKRRNILRKIRTLELKARKWWAYAWL

SEQ ID NO: 3101 - protein, 20 aa, synthetic construct
WFRILRKLLKRWKNDLPRAC

SEQ ID NO: 3102 - protein, 32 aa, synthetic construct
MFRLFRRFLRKLNPFQRRLLFRGLIECAKKYA

SEQ ID NO: 3103 - protein, 49 aa, synthetic construct
LWRFLRRFMRFWKREAEAKARFKRADVMIKAKLIRLSRLATQLENRWPF

SEQ ID NO: 3104 - protein, 25 aa, synthetic construct
KFRLLPKLFKFLRRLYLHSFRPAIM

SEQ ID NO: 3105 - protein, 91 aa, synthetic construct
KMKFLSRLLRIFKRSAPGIRWDNARDERRALKAWNKCKAQAAAKKERAPTLNWQMAIAWLKHKPLALMRCSAAEKDLRAAAHIRMYLYPLR

SEQ ID NO: 3106 - protein, 77 aa, synthetic construct
RFKLISKLLRRFRPRDRWRLKAKKRTRAAWAALKGEYEARRRWSCLHATAWQLFWELKERRKILLRLCSMRAKNDRK

SEQ ID NO: 3107 - protein, 58 aa, synthetic construct
KMKFLHRMWKILKSDRAFCQQKYRLADLARRQPLCLLKKKWPLCKAVATFAGMLKLFA

SEQ ID NO: 3108 - protein, 55 aa, synthetic construct
KLRFIKRLYKKLRKLPYKRKHLKMYARAHNFGNNGLVCLKLKFHDKDLMCALKRY

SEQ ID NO: 3109 - protein, 42 aa, synthetic construct
WLRLWKRLFKFLPRKAAKKKKLLRIHPSLKIKRAYAHMMDNA

SEQ ID NO: 3110 - protein, 45 aa, synthetic construct
LMKLFKKYLRKIRSAKLAFFDSMARAPCQRHRNLCKAGLCRLGRM

SEQ ID NO: 3111 - protein, 31 aa, synthetic construct
IMRLIRRFLKKIQQILIRAALLMCRRCKVKA

SEQ ID NO: 3112 - protein, 29 aa, synthetic construct
KLRLLRRLLKRYNHIKRPDTYEHAIFARG

SEQ ID NO: 3113 - protein, 27 aa, synthetic construct
LLKFMRKLWKMLHRKCLAAQAVWHSRR

SEQ ID NO: 3114 - protein, 92 aa, synthetic construct
MMKYLRKWFKWIKKALALLAEKPADRDAQRAACKRAFQCRMAADGRQLGWTEHRGKNCRNLRWDQKALNRGCMGAALRRKRLSPKWLKNLLA

SEQ ID NO: 3115 - protein, 60 aa, synthetic construct
YLRWLKRLFRFIKCALGWKIHVALPRQNLIGEEARGKLALTLYRKSVDKLLKLLWLMKHK

SEQ ID NO: 3116 - protein, 80 aa, synthetic construct
KLKLYRKMMRRIKRRLRDAKAAKDLAYLGEWLKWKKCPPFVAFGISQDANYKALGHLCKRLLIKFPKRLKRLALNAMQHI

SEQ ID NO: 3117 - protein, 45 aa, synthetic construct
FIRMYRKMLRKINRKLWSYHKATRWAFLLDARAQGKADRRLKAAF

SEQ ID NO: 3118 - protein, 28 aa, synthetic construct
RMKLLSRLLKKFRQKLLMLHNIRDKPAS

SEQ ID NO: 3119 - protein, 36 aa, synthetic construct
RFRMLTKMLRLWRRCRLEKAIAPLLYRMKLYRMKHS

SEQ ID NO: 3120 - protein, 20 aa, synthetic construct
RLKLWKKWLKRFNHVSVLLS

SEQ ID NO: 3121 - protein, 59 aa, synthetic construct
FLRLITRWIKLFPHYKCAVDINKCLRIKEIRKIAAAKYRLCRLRARLLLAHARISLTLN

SEQ ID NO: 3122 - protein, 33 aa, synthetic construct
IFRWWNRLLRKLKRGLASLAAKTGLADLRYKDV

SEQ ID NO: 3123 - protein, 76 aa, synthetic construct
KFRMLTKFLRKFRRLKMNLKWADSKKYRTAAGLLVKHDIRKHMRHFFLRRFARARFMYPRLFSMGAALRAKLEHRN

SEQ ID NO: 3124 - protein, 70 aa, synthetic construct
MYRMFRKILRFIRKKETMQNLLLKDDLYHKCRLRQRRWLRLLHLLWLGPKRFACAAKLAQYKDKEAALAQ

SEQ ID NO: 3125 - protein, 25 aa, synthetic construct
FLRWFKKLFKKFSPALKLDLRGQRL

SEQ ID NO: 3126 - protein, 67 aa, synthetic construct
RIKMWRKFYKILHKFYPQLKPTFHLIACSKALQDLKKKNKILMCVVAKKLAEAKGKAVLKRRLANAL

SEQ ID NO: 3127 - protein, 96 aa, synthetic construct
WMKIMKRLFKRLQCKLMARCRIREHTRKIRCAKLKRKLLFLHKKNRLKAPSWCKRTALAQQLLWLCRRMFCEYASRAYPERLAQLLTGDMAGKARI

SEQ ID NO: 3128 - protein, 88 aa, synthetic construct
FWRIFRKLLRMLHRHVKKKAFTQLKSALALITLCHSRLRKPIACPLARKAEKPLLCAKAESDLLLAAAFRHWWLGRIGLKYLNQPKLK

SEQ ID NO: 3129 - protein, 26 aa, synthetic construct
KLRYLRRMLKKLKKLHAWMVGLVARK

SEQ ID NO: 3130 - protein, 30 aa, synthetic construct
KYRLLKRLFRKWKHMLWSAKCVKLKLFIGD

SEQ ID NO: 3131 - protein, 24 aa, synthetic construct
FLKWISRLMRLLRHKRKEALHLHP

SEQ ID NO: 3132 - protein, 56 aa, synthetic construct
RFRWMKRLIKIYRRKKRNMFARQLTAAARINAPRAKALNAKACRGELGLLTINSAA

SEQ ID NO: 3133 - protein, 58 aa, synthetic construct
KLKYFHRLLKRLKKLGRAVVLKHMNQHKLHTCRREALARRGRREEAIEAALFLYAAPR

SEQ ID NO: 3134 - protein, 28 aa, synthetic construct
FFKLFNKWYKRLKRLRQLLRVLCAAEFY

SEQ ID NO: 3135 - protein, 41 aa, synthetic construct
LFRIMSRLLRFLKQAQAVLTPKLAKVADAERRIEWRRAPLC

SEQ ID NO: 3136 - protein, 65 aa, synthetic construct
KLRFWTKLLKKLRCLPNAKRDYLLAKWLDARKHQHLKCVMLLLMHFWRHKIGLRKRPNRWKMIKN

SEQ ID NO: 3137 - protein, 40 aa, synthetic construct
FLKLLRKMLRRFHQANEARVCKVLAKRALCKKLLRCRLIA

SEQ ID NO: 3138 - protein, 42 aa, synthetic construct
KLRYIKRLFKKYQCLKSLKRYRAKGSRPAPLVANDRAHWLDL

SEQ ID NO: 3139 - protein, 71 aa, synthetic construct
KLRLYKKFFRIYKKRQVQRKRRHFGAPLAKRWAPAAVPLRLLIARHKCAQLTSLNVSLCLVHKLLSKCFRK

SEQ ID NO: 3140 - protein, 31 aa, synthetic construct
KLRLLCKILRRLTTMFCKADAMLMRFRRDRE

SEQ ID NO: 3141 - protein, 60 aa, synthetic construct
KLRFLRKLLKMFRRWNLWLNPASNDNLHLATARARKGLRMGLKHAKALIKENDWLERVDA

SEQ ID NO: 3142 - protein, 76 aa, synthetic construct
KMRFFSRLFRRLKQQLAFLRKTRKTDAAKKTRRKLRELVAMKYMLIAWRAEPRKKLAGPMKDKVLLAVTLRVKAMQ

SEQ ID NO: 3143 - protein, 96 aa, synthetic construct
KIRFYTKLLKLLKRRGTAKAILYPAHKSISGKTRHMLRPYSRFLMALPRHGLLKKLIAAAAAPVAAIRACGLRARRFKVFRIQPKKLDREKLDAIY

SEQ ID NO: 3144 - protein, 23 aa, synthetic construct
KMRLIRRLLRMFPKQLASAPSAR

SEQ ID NO: 3145 - protein, 20 aa, synthetic construct
KLRFLSRWLKRYTPKAHCAK

SEQ ID NO: 3146 - protein, 35 aa, synthetic construct
LLKILTKIYRFWRQAYKAFFARTLQRKLHSGKKLA

SEQ ID NO: 3147 - protein, 32 aa, synthetic construct
RWKLYKKLLKMICSLSFAGALKCRRRLCEERT

SEQ ID NO: 3148 - protein, 98 aa, synthetic construct
LIRYFTKLLRRMRPLKRIKLKFKRRIQRRLLFIRLRDKALSMLRMRHAMAAGLHKICKIERDGKALTCFRRRFVDAKHFCYLLIAARLKNLRAVQRFP

SEQ ID NO: 3149 - protein, 58 aa, synthetic construct
RFKLLKKIIKRYCRLAPVRLKPAWAKRKCAKLENAQVACKTFAPKDRLSARHQQNRSS

SEQ ID NO: 3150 - protein, 33 aa, synthetic construct
KYRLFRRFLKMLTKLTKFRDWRLADLWLEKHFL

SEQ ID NO: 3151 - protein, 28 aa, synthetic construct
LYKLLSKLWKRWSRATKTLARMPAKKRG

SEQ ID NO: 3152 - protein, 24 aa, synthetic construct
WLKLMTKLMKKIRQKDLARAKVIA

SEQ ID NO: 3153 - protein, 25 aa, synthetic construct
WWRFYKKLLRRLNRVHMWAVKKLLY

SEQ ID NO: 3154 - protein, 27 aa, synthetic construct
KYRIYKRYFKLMQKLLAQLRGWVADRA

SEQ ID NO: 3155 - protein, 45 aa, synthetic construct
RLKFLKRYLKLLKRRYLRMKIIKRKRVIAAHCDAFCFSLECAAWQ

SEQ ID NO: 3156 - protein, 21 aa, synthetic construct
RLKFFQKFLRKLNRASHLMTA

SEQ ID NO: 3157 - protein, 66 aa, synthetic construct
MMRFLCKYMKRMKRDRRAHRKKALALAFMYAPKTAGGRHLWKNHFCKLDKLARWKALIIRTAACAP

SEQ ID NO: 3158 - protein, 98 aa, synthetic construct
RLKILSKFWKRLCSARRDHRGKQRKLAHRRFQQSLLLRYLAAALRVKAGLRKQSKLFTKARHRTITRNKGYERTDHRIRRHLPLELWALIKIELLTTR

SEQ ID NO: 3159 - protein, 66 aa, synthetic construct
KFKYWNKLLRYLHRKSRAAIFILRFQPNSMPWDLATLLRECAKAKSRRKALRLQQRALAVKWKNLH

SEQ ID NO: 3160 - protein, 48 aa, synthetic construct
ILRLWTRYIKFMRRSLWKGLFALAAKRKLKKRYNCKCKLGSQAALKVV

SEQ ID NO: 3161 - protein, 20 aa, synthetic construct
KWKLFKKFFRMLQSRLAALG

SEQ ID NO: 3162 - protein, 55 aa, synthetic construct
KIRMLSRLIRKFRKAFHILRARDLSAKAMLAYALLQQRSARNIRHGFKMRWAKCG

SEQ ID NO: 3163 - protein, 54 aa, synthetic construct
RIKLFNKLIKFLKKLGAKKLTRVKVALMIMLAQMEKCAPCTKKTWKAHAATRWR

SEQ ID NO: 3164 - protein, 29 aa, synthetic construct
KLKILNRWLKWFKPYPAAKRVVASKWAPK

SEQ ID NO: 3165 - protein, 30 aa, synthetic construct
MWKLYRRIMRKWHNLAMWDKALCRRLLIKK

SEQ ID NO: 3166 - protein, 36 aa, synthetic construct
YLRIYKKFLKRIPRCGGTPCKALKARSARAILDKAH

SEQ ID NO: 3167 - protein, 47 aa, synthetic construct
YLRIIQKLIKRFKKQLHYALRRYRLKRKSDVSRKIAEQNALLVAYKF

SEQ ID NO: 3168 - protein, 67 aa, synthetic construct
KFKLIHKFFKKLHSEIMAKLKDFRALQARKLAPYKLALFMRLYKMLMKAWKTDRNRWYRKWLKTLAI

SEQ ID NO: 3169 - protein, 34 aa, synthetic construct
KYKLLKRYFRKIPRYAEWAEHLAAGLKAAPQAKS

SEQ ID NO: 3170 - protein, 55 aa, synthetic construct
RLRWLRRLLKWLKRKLCLEAHRWDAFRKKGLNKTWAACGRRPKRAHLAWPMAVRR

SEQ ID NO: 3171 - protein, 24 aa, synthetic construct
FYKLFHRILKMLKRKYKATASFRA

SEQ ID NO: 3172 - protein, 29 aa, synthetic construct
RLKLLRRLFRLLQRRKQIFWNRPWLSKPA

SEQ ID NO: 3173 - protein, 49 aa, synthetic construct
KLRLFRRFWRLLRPCALRQGKVRQLAAYLVMCKIKPKMRARALNGREKF

SEQ ID NO: 3174 - protein, 50 aa, synthetic construct
KIKLFHKMLRRMKKHLRKEERCCLLLTKAPHKRIRFFLLRCARHALYLQA

SEQ ID NO: 3175 - protein, 51 aa, synthetic construct
KFRLFKRLLRFWRHATDCHCNQLLSRYKALLYTNKRKATRKRGLWRVKVLR

SEQ ID NO: 3176 - protein, 75 aa, synthetic construct
RIRMMKKLWRRLKCHSFKAKLLGIRNVRACKMWGQRKLFAAVAKNTNWKKARLVQLKLLNRGAMKALFKRGDFPK

SEQ ID NO: 3177 - protein, 44 aa, synthetic construct
KLRLLRRLLRLFRKRHLTKKKWFLKKYRRMLKLKKLALAPRNWL

SEQ ID NO: 3178 - protein, 50 aa, synthetic construct
RLRILPRLLKRFRPILLDDYLGLTDVPRKGKARATTTLLKAKKLKLLCLL

SEQ ID NO: 3179 - protein, 59 aa, synthetic construct
RFKLIQKLLKKMRKAKACKAACKVCSGLFAELKILGWYANLQLALVGLYKRLGKRMEFY

SEQ ID NO: 3180 - protein, 28 aa, synthetic construct
LLKFWQRFMRYLRRMASRCKALKAEKYC

SEQ ID NO: 3181 - protein, 78 aa, synthetic construct
RFRWLRRYIKLLRSDPEKLKKPAMWERCQCHLLRRDSLAKRPMISSALRGGCFPRTKRALGLHKAAAAYKKARKLARW

SEQ ID NO: 3182 - protein, 54 aa, synthetic construct
LIRLLSRLLKRFRRRLRAPRMDNQLDDWLMGIQRERALMECANIYKLALAMFKA

SEQ ID NO: 3183 - protein, 89 aa, synthetic construct
RLKLLHKLWKRFQRLYAFRALFANHLAYKNYRSSREEKNARARQLLLRTQAKDAADRDQRAGDAQLLQVFKKCARSESTLAAVHLTQRA

SEQ ID NO: 3184 - protein, 65 aa, synthetic construct
LYRLFRKFLRLFNKVRLVRRRQRKFAAAKKNTAMLRLTLLNIQPIKFACLMISYELAAWCCAWAK

SEQ ID NO: 3185 - protein, 37 aa, synthetic construct
KLRLFRKMYKLMRTFAKTSKKKIAHAAHAPAILCKGA

SEQ ID NO: 3186 - protein, 22 aa, synthetic construct
KMRFLPKLYRKFKRLCLALMSQ

SEQ ID NO: 3187 - protein, 40 aa, synthetic construct
LLRFYHRFLKLMRKRDKATEKANRAKDCFDQFIRMRLVRL

SEQ ID NO: 3188 - protein, 39 aa, synthetic construct
KIKLFQRLLRLMRKKYACQLKHLEVARLRPAALATWRVL

SEQ ID NO: 3189 - protein, 31 aa, synthetic construct
LMRWLKRFLKRIKNERYRQGITCMLKALKLL

SEQ ID NO: 3190 - protein, 45 aa, synthetic construct
LYRIINRLMRRLNCHLKQIMCMLLLRRDARIKLLKANLKAHRWEY

SEQ ID NO: 3191 - protein, 60 aa, synthetic construct
LFRFFKRWLKKFRTQIHARRLARCARRAYLKACEYCRLSLKALGAHAMSKELLSWYYLKR

SEQ ID NO: 3192 - protein, 33 aa, synthetic construct
KYKLINKLMKRLRTLHLRGLACGAAVDPVARRC

SEQ ID NO: 3193 - protein, 82 aa, synthetic construct
RLKFWQRMLRRLCKCYSKALKASYMRKFKKKWLAGKCFKLKKKNLKCRLSELRCCWHKKLTVRLLKHHRRALLSVALMKQAA

SEQ ID NO: 3194 - protein, 32 aa, synthetic construct
RWKLLHRILKRLTSAEGSRFLRWPRYAPKKAQ

SEQ ID NO: 3195 - protein, 43 aa, synthetic construct
KYKWLRKYLKFYKRLHRQAANRGLKLANREKGHLKPLRAWCLK

SEQ ID NO: 3196 - protein, 59 aa, synthetic construct
RMRFFNKYWRKLRHADILRFLGREAKSAKALRLKKCACALLRKCLRLRDGGLTAELAET

SEQ ID NO: 3197 - protein, 67 aa, synthetic construct
RWRLIKKLYKLWKKMPAQLKSRNFMCFLTRACRLLAVIMALLRLPLTAKRLRAKKAFAKENRKRYAA

SEQ ID NO: 3198 - protein, 21 aa, synthetic construct
RLKLLQKLLKRLCNKGKALDV

SEQ ID NO: 3199 - protein, 38 aa, synthetic construct
KLKLFRKFIRRWQRNTKTYAIRDLLAQDLTAWRERTRL

SEQ ID NO: 3200 - protein, 29 aa, synthetic construct
RWRWYQRYLKLIRRAAAYRADYFHCRAMA

SEQ ID NO: 3201 - protein, 45 aa, synthetic construct
LLKFYNRLLRIFTRDLRFKLDPFRKRPAAARKTLQGNLRHNKCAK

SEQ ID NO: 3202 - protein, 51 aa, synthetic construct
RWRLYRKILRRYRRFRNAANSDFARLKMAQQRRLWLTTTAVARAGRTGAYK

SEQ ID NO: 3203 - protein, 31 aa, synthetic construct
RLKIFRKFIKKLHRALYLSAELWGRRVLFNL

SEQ ID NO: 3204 - protein, 55 aa, synthetic construct
RIRLWKRIYKLFTPCRKAGKDADKFWKKADAKRRCATTALPAAFEARKSLGRHHA

SEQ ID NO: 3205 - protein, 37 aa, synthetic construct
LLRYWKKYLRKYKKYGRWRALRAMRKDQLHAALGDRM

SEQ ID NO: 3206 - protein, 65 aa, synthetic construct
LMRLLRKYLKFMRKAAKRNRCPRIADATETKIAKAFIVRTAVRAPNLRACKLVCEMRAWLFASRN

SEQ ID NO: 3207 - protein, 34 aa, synthetic construct
ILKMFHRWFRRIRPARLRGREYYVAAKLLCLGRK

SEQ ID NO: 3208 - protein, 24 aa, synthetic construct
KFRFLKKLYKKLKKLAAAMAARCS

SEQ ID NO: 3209 - protein, 34 aa, synthetic construct
KMRMYKKLWRKFTKRDEYLALRRLELTQNAMLLL

SEQ ID NO: 3210 - protein, 35 aa, synthetic construct
LIRLYRRLIKKLQHMARLSCKGCSLAKLLFKIKDQ

SEQ ID NO: 3211 - protein, 46 aa, synthetic construct
FLRLLRKLFKKLKREAADFLCQIREKARSYILLSAVLRHLEYANCG

SEQ ID NO: 3212 - protein, 72 aa, synthetic construct
FWRLYKRIMRFLQPADAVKQRYLDWYTLRAKARFLFKKRRVLIAGKKRLDAPLRGKRQMRLIHTKAQLLHAR

SEQ ID NO: 3213 - protein, 31 aa, synthetic construct
KWRMLQKLWRKWKRYRWTATAANRFMHAKAA

SEQ ID NO: 3214 - protein, 55 aa, synthetic construct
RLRFMSRYLRLLKRAARVLLWHYRLVKAKRFAAPASANFPLERCMVFQGLVLKDR

SEQ ID NO: 3215 - protein, 38 aa, synthetic construct
LLRLICKLFKRFRRNGVMVKRNDAARALLKWRYMDKGT

SEQ ID NO: 3216 - protein, 32 aa, synthetic construct
RLRLLRRFIRLWRKDAGTKGATLQACLRTHLR

SEQ ID NO: 3217 - protein, 21 aa, synthetic construct
FWRLLKRLLRRLCSKGAHAKC

SEQ ID NO: 3218 - protein, 33 aa, synthetic construct
RLKWMKKFLRFLKRLFQAWLLCKSKKAMNRDQA

SEQ ID NO: 3219 - protein, 66 aa, synthetic construct
KFKYWSKMIRLWRQAPRLARMNLGKLLKMAAKLPSDPARMKDRRYFEACRNKRYATLVEKRRKLAW

SEQ ID NO: 3220 - protein, 90 aa, synthetic construct
LYKFWRRFLRRMKCLWTKKILQKVLALRLLANPKKLWRKLKALMRSLHWGEMTKPKNALALYRVPLAKSKLSRADLLTATKALRWKRISL

SEQ ID NO: 3221 - protein, 69 aa, synthetic construct
KFKYWRRFWRRMRKKAATCAFDGMLKMRKKLTTAELIRERAFALARQRKRFRNKEADSLGWKTLWAALL

SEQ ID NO: 3222 - protein, 36 aa, synthetic construct
YFRLMRKFYKKLKQAIFKPLALWKNCPAAVWSLRRR

SEQ ID NO: 3223 - protein, 52 aa, synthetic construct
LLRFFSRMYKKLKKDAMLLATRRRKAIRPYHAPNEKNKLQSFLYCLAKLRPR

SEQ ID NO: 3224 - protein, 26 aa, synthetic construct
LWKFLRRFLKWLNTRLEAKMERIIAA

SEQ ID NO: 3225 - protein, 56 aa, synthetic construct
ILKYFKRFLKFLKQCWAKQERPAASADFCKARLFMCILSASKAAHNRRDRALLKVL

SEQ ID NO: 3226 - protein, 27 aa, synthetic construct
KLKFLRKLLRLLRKTCYAGDRELRCGA

SEQ ID NO: 3227 - protein, 34 aa, synthetic construct
RMKLYRRILRLLPRVLARATIHKCKAGAAKGYML

SEQ ID NO: 3228 - protein, 34 aa, synthetic construct
KFKFYKKLFRKITKLIQKADQVGRLAIMARARAW

SEQ ID NO: 3229 - protein, 44 aa, synthetic construct
KWKILHRLLKLYKREIQRWALWKKLIRQCYARRKHHKAMQFLVA

SEQ ID NO: 3230 - protein, 30 aa, synthetic construct
FFKLLKRMYKLFTKLNKKSGARNAHLVDAR

SEQ ID NO: 3231 - protein, 44 aa, synthetic construct
ILRFYKRWFKLYNKVELVKTRLNKYATCRAFRLRRACMLRAFLR

SEQ ID NO: 3232 - protein, 63 aa, synthetic construct
LLKWFQKLFRFFKKTKLRKARILQRARNAHNEKALEKWYKHKKRSKLAKLARDCLYWADKRMN

SEQ ID NO: 3233 - protein, 69 aa, synthetic construct
KWRFLNRYIKFWRKGKRWRREKRLAALKRLLHVRLGGDLKLAEMLGQCASLAAKLSRLTAADDKGHGVY

SEQ ID NO: 3234 - protein, 40 aa, synthetic construct
KLKLFTKWYKLLKCKFSHWRPVHFGKLAIRGQLKLLAPLR

SEQ ID NO: 3235 - protein, 39 aa, synthetic construct
RIKMFKKILKKYQKEPVKTLLRAKCLVELVAHRYLRAMA

SEQ ID NO: 3236 - protein, 26 aa, synthetic construct
ILKLIKRWLKKLSQLRAKGGQQQLFL

SEQ ID NO: 3237 - protein, 26 aa, synthetic construct
RLRILSRFFKLLKRKRAALWEMSAWP

SEQ ID NO: 3238 - protein, 42 aa, synthetic construct
KIRFLKRFLKMMKKRVAYAAASIEFRWRKCQPLNALLTLAKS

SEQ ID NO: 3239 - protein, 45 aa, synthetic construct
RFKMMCRMLKWMKRLLLAALCWKKCQHKVNLKRIGGLLLKREKSW

SEQ ID NO: 3240 - protein, 87 aa, synthetic construct
YFRWIKRYWRRFCSLTLLLRAKDCAVLSLRAMYALRPHKVPKVWGTECADVKRRNLYRRARMKDRQKFLARAAARAPARIDALPLVK

SEQ ID NO: 3241 - protein, 30 aa, synthetic construct
KFKYLRRLMKLLKCELHLGCKRRRTSFAAN

SEQ ID NO: 3242 - protein, 21 aa, synthetic construct
RMRLYKKLWKRWRTAEATYIL

SEQ ID NO: 3243 - protein, 30 aa, synthetic construct
IYKLLRKLLRRIRRPDMKLDESPMLLKNRT

SEQ ID NO: 3244 - protein, 67 aa, synthetic construct
RWKLLPRLLKRYKKKWWAAACPFLADRTAKLSLWKLFTMLRHNRLKQKKRLCNSHKLSWRRAEFLKG

SEQ ID NO: 3245 - protein, 60 aa, synthetic construct
LLKFFKKMWKIMRNGNKRLAIKALTWFTRWLLTDMGWVLKGAAHARAMAVALRKKLLFRM

SEQ ID NO: 3246 - protein, 30 aa, synthetic construct
LLKLLKKLLKIWKQLIRLKHKWNYRKAAKG

SEQ ID NO: 3247 - protein, 59 aa, synthetic construct
KLKWYQKILKKLRKFPKAKLTEYKVGQYARMIQRLKAIAKAARLKPKALAGCRKLRRFW

SEQ ID NO: 3248 - protein, 44 aa, synthetic construct
FLRFFKKFMRFLKKLMLAPKFHAKARKIAGKADALYKRKLKRDA

SEQ ID NO: 3249 - protein, 27 aa, synthetic construct
FYKIYRKYLRLFKKLPKSSLLNARHQL

SEQ ID NO: 3250 - protein, 60 aa, synthetic construct
KMKLLCRLLRFIQKYMSAVFAKSLMARVAMYCTHAASLARLAKKKLKDEQACKRMRTKLK

SEQ ID NO: 3251 - protein, 62 aa, synthetic construct
RLRMLRRLFRLLSPIKIREAYALAYLAAQAKALLSKWRLWRKKQKGRRADYCRYLTKIAHAV

SEQ ID NO: 3252 - protein, 80 aa, synthetic construct
LLKILKRMFKLIRPLLQGKHKLGDLLLLAAKYILADKAVSWRDLPLPLIMKKSNRKLDWLFLNFINGYGKKKRHLKRADL

SEQ ID NO: 3253 - protein, 48 aa, synthetic construct
RLKYLRRWLRRMNKTRAGRVQREKIRAMHPAGAVATLRAYSLRCADLN

SEQ ID NO: 3254 - protein, 39 aa, synthetic construct
RFRILRKFYKLYKHEAALVCAALRAARIYYKLKRQVCRG

SEQ ID NO: 3255 - protein, 38 aa, synthetic construct
WMRFLHRFLKRIRKHMAACRKALGWYKAKAQLIKKPTE

SEQ ID NO: 3256 - protein, 29 aa, synthetic construct
KLKFYRKWLKKYRCAKRENALSMAGGGLF

SEQ ID NO: 3257 - protein, 61 aa, synthetic construct
RMRWFKKFLKIMKKKQPEAFLLLAKVLCHRRANKMAFPKLKTSASKKLGYRFARLAERRLY

SEQ ID NO: 3258 - protein, 69 aa, synthetic construct
KMKFMTRWIRRLRRFNRPRAEKLCLKTHTACQILSDPRQFKALTHRLIHYKAYKLALLLRARLLRLGKT

SEQ ID NO: 3259 - protein, 32 aa, synthetic construct
RMKYLSRMFRKISCRAAPALPASELAKAIARQ

SEQ ID NO: 3260 - protein, 54 aa, synthetic construct
KIRFFCKLLRKYKKIIKWIRMRQALNKDANARAPHEKRLCAGAARRTVKAIMLS

SEQ ID NO: 3261 - protein, 32 aa, synthetic construct
KFKMLTKLIKKLKKALNKPRDLLLKPGCKALR

SEQ ID NO: 3262 - protein, 32 aa, synthetic construct
FLRLFRRILKILRNLDLKGLSPRDRKALKKNL

SEQ ID NO: 3263 - protein, 45 aa, synthetic construct
YWKILQKLLKKLRRDCQLRTQGRARWLRKRKACACAWRALLAAPN

SEQ ID NO: 3264 - protein, 80 aa, synthetic construct
WFKMMKKLLKYLQRSFKQVLDRSKLQCALKRDSKLKDLQLACASAKQKLAKRAKNQCSEANLMPARMKKAMYDLKWRFER

SEQ ID NO: 3265 - protein, 20 aa, synthetic construct
KYKYMTRLIRLYRKAATNKL

SEQ ID NO: 3266 - protein, 28 aa, synthetic construct
KYRFMKKLLKLLSPRFAKLLKLTLCDPR

SEQ ID NO: 3267 - protein, 65 aa, synthetic construct
KFKMFQRYLRKFKRRKDWTCKLTLRAAQALKANLKKFCYWPLWAKLFQLLKSDKNALASERKCVR

SEQ ID NO: 3268 - protein, 43 aa, synthetic construct
IMRFIRKFLKRYRKFALAAEDKALAKKRYLVYKNIRHTQAVAQ

SEQ ID NO: 3269 - protein, 34 aa, synthetic construct
KLRLFRRLIRRLQRWLARVSLWAIMHHLALARRR

SEQ ID NO: 3270 - protein, 54 aa, synthetic construct
LWRILKRLLRKLRRAKARAHDRRFRQWIYAVFQSTRWRVFWLQAPLKHAGFLHA

SEQ ID NO: 3271 - protein, 63 aa, synthetic construct
MIKYLPKYLRKYNPARTQLRWEWISCCNRACAALLKLAMSYLKWALLRWREWYLRKKLALIRR

SEQ ID NO: 3272 - protein, 22 aa, synthetic construct
LLRFLSKLLKYIHKMYRLKAKM

SEQ ID NO: 3273 - protein, 52 aa, synthetic construct
LLRWMKRWMRILRRLYWCRNRYKRKKRGKKAVEAPQKEAFGDNTLALAATHR

SEQ ID NO: 3274 - protein, 26 aa, synthetic construct
LYKWLQKFLRKIKKGSDLFLAKAPLT

SEQ ID NO: 3275 - protein, 24 aa, synthetic construct
RLKLFPRWLRKMKKRRLALLPAWP

SEQ ID NO: 3276 - protein, 20 aa, synthetic construct
RLKFLKKLLRMMNKDAKCAS

SEQ ID NO: 3277 - protein, 28 aa, synthetic construct
KYKMLKKFYRRYRCAARILFRAAELMWF

SEQ ID NO: 3278 - protein, 36 aa, synthetic construct
RFKLFRRIIKLFPNYAAKHAKAKFCNADDKLLSRKL

SEQ ID NO: 3279 - protein, 50 aa, synthetic construct
IWRLIKRLLKRFTRLWHNQYACCASSFKLTAYIAACLRLWDAAHLKKKKK

SEQ ID NO: 3280 - protein, 37 aa, synthetic construct
KMKYYNRLMKLMTTGALWRKIFACLLRAQRRLLYRRL

SEQ ID NO: 3281 - protein, 78 aa, synthetic construct
KFRMIKRLLKFLKRHDKALKFHRLNHNAPVERWAALTLSKMSPGTGLLKGHKARGLVTLELKVLRLRCLWWKAKRLAL

SEQ ID NO: 3282 - protein, 99 aa, synthetic construct
RYKFLKRLLRLIRRLLLARKWVLRVSKKVEVATAKHALCRIVLLKNMCKKRCLALMDSQKARLCSLPLGRKFKAVPDSPKLKRRAGHTEGIRDGTALGQ

SEQ ID NO: 3283 - protein, 25 aa, synthetic construct
FLKILRKYLKRYKKYECLWKKLAAL

SEQ ID NO: 3284 - protein, 100 aa, synthetic construct
LIKMLRKLYKKLRRNKQKNIALRTHRHALRAHPPLLKERKGARWRLRWMLSMLPLMFVRLNAWWDWSKKRDWALRKYLKWMNAMLMSAKKKNWHQKCAKP

SEQ ID NO: 3285 - protein, 38 aa, synthetic construct
KLRLMCRLFKRLTCHLALSSKALKTLRDRERKLTYDTK

SEQ ID NO: 3286 - protein, 50 aa, synthetic construct
KLRYWRKFLKFLRNKWAHKRTRARCLALLAMDNFKAKRRHPPYLLLYLYM

SEQ ID NO: 3287 - protein, 88 aa, synthetic construct
RMKFFNRFLRKYHRTNIDRTRLVVARLQNLAIGYLLPKYFKLRLNRRPERWWRKLARVQSLLLAGRKAIVMALAGKLRLRVLVNRIKL

SEQ ID NO: 3288 - protein, 22 aa, synthetic construct
KLKFFRRLYKLWNRCAQRLLML

SEQ ID NO: 3289 - protein, 22 aa, synthetic construct
KLKIFQRLFRLFRPRFRVYALA

SEQ ID NO: 3290 - protein, 86 aa, synthetic construct
KLKLFPRLYKFLRKTKAKYELLERRCAALDWSHKEWRKRALQSKAVYDLNNADLRLAIRLRALFGSRCGAKLCLYRRTETCCTLRL

SEQ ID NO: 3291 - protein, 23 aa, synthetic construct
FLRLLKKLYRKFKREKLCLCNKL

SEQ ID NO: 3292 - protein, 51 aa, synthetic construct
LYRWYKKLIRKIKSFARKLGLALCREWAQFGYALYRRLRRKIRAYYVRNLL

SEQ ID NO: 3293 - protein, 74 aa, synthetic construct
FLKIFNKLWKFLKRLLKRDDPDEYMLRLYFAALVFAKKNGLKKHTLTRGDQFTVKAKARVALYRMRAAALELAL

SEQ ID NO: 3294 - protein, 87 aa, synthetic construct
FLKYLKRLLRLLKTRKLKKTGCADHRCAAKYNRIATRGATKSDAKRARGQKTSMCKLCLYQRALEYITRLLQCKARKLLNLLAALAK

SEQ ID NO: 3295 - protein, 32 aa, synthetic construct
KWKLFRRFLRRIKNCLRKQSYKLQLVNRLAAM

SEQ ID NO: 3296 - protein, 97 aa, synthetic construct
KYKMLNRLYRRLRTAGTKHKIGLKLACKVDKWRNAACLLHFILKYFHKGKFALMASQAKRQIKLKKLKRKRPKVALWNHERDAAKKLKLKSMRMFWR

SEQ ID NO: 3297 - protein, 63 aa, synthetic construct
KLRYFCKYYRRLPTRKKQIRAMPAFPDRRRCLAILGVPNKAWRAKLQKKAAGKLERHKASQEA

SEQ ID NO: 3298 - protein, 38 aa, synthetic construct
RIRFYKKLLKRLRNRAIHKHFLKKQLAATAALHKNCYK

SEQ ID NO: 3299 - protein, 55 aa, synthetic construct
ILRLMKRYFKFYKRTRRQRDTPLKADAAKAWRLALFLKLRGMYQRKIKGRPCGAL

SEQ ID NO: 3300 - protein, 46 aa, synthetic construct
LWRIMKKMMRKYRNQSRAALVAGSEPAHRKAYLFLARLRLRKTLCM

SEQ ID NO: 3301 - protein, 41 aa, synthetic construct
RLRLFTRWYKKWRKKNLAKVKILVLDQAAKYRAGLRRIAGK

SEQ ID NO: 3302 - protein, 36 aa, synthetic construct
RLKFLTKLFRFFSCIAAARCEAKDRKLRKALAWAKA

SEQ ID NO: 3303 - protein, 43 aa, synthetic construct
FLKLWPKLIKFLKTLPSMANRGEAKAKYRLSCRGLIAKEKLLS

SEQ ID NO: 3304 - protein, 45 aa, synthetic construct
RMRWLPRLWKKLRKWLLCMVRPDTLTWLHLAGIASALKCATRLRK

SEQ ID NO: 3305 - protein, 60 aa, synthetic construct
FFRLLCRMLKKIQSKNRSLYLRARSKILLQAALAIVGKYKMIKAPKPIKKGRLDIQPRKK

SEQ ID NO: 3306 - protein, 22 aa, synthetic construct
LYKLLRKYMKWLPTIHLRKKYL

SEQ ID NO: 3307 - protein, 72 aa, synthetic construct
KLKYLRKLFRIIHRGRTTRLLLRLDRKHLAARCCLRWKWFSRIHTFRAKAGMKLGELGLIILCLRNARIGFR

SEQ ID NO: 3308 - protein, 22 aa, synthetic construct
LLRLYSKLIRYIRQKLRPKVAD

SEQ ID NO: 3309 - protein, 77 aa, synthetic construct
RYRFLKKFIKLLQKYALRDSRKKHLFLALGKCVLKLLQMHARDHAKHKTSHAARAHELYKARDATRAIFELRPARLA

SEQ ID NO: 3310 - protein, 59 aa, synthetic construct
RMKWLSRLFKLIKTRLRPLAWKMRRRLLKAHLQRDHRRRFFRFIRLAIAKAGVKTPYHA

SEQ ID NO: 3311 - protein, 53 aa, synthetic construct
KLRFFQKFFKKMKKSAMAKAHLLANKIKAIAKARFYQLWLLHNKKKYALAGRK

SEQ ID NO: 3312 - protein, 74 aa, synthetic construct
LWRFMKRLLRRWKKAQLLKLPWRARKRLGRGKMHRVRARLALPARKFLRDLGLRDLAKEKQAHKASREKKPKQH

SEQ ID NO: 3313 - protein, 65 aa, synthetic construct
LYRLYKKFLKRMNRLNKLAILRGMHQLLRVNRGGKDRVRLHRAWCLVRAIAALRRRFLLYLWKRA

SEQ ID NO: 3314 - protein, 54 aa, synthetic construct
RLKLLKRYLRRLKRYLTQNTTMRANFRVKMLLVIRKANGHAHLLKKLDRKKRYW

SEQ ID NO: 3315 - protein, 57 aa, synthetic construct
RLRIMKRLYKWFKCFPAHRLMNRQGLRKRWKLLHFRLKRAHLPWLLVENKEATAAAR

SEQ ID NO: 3316 - protein, 54 aa, synthetic construct
FLRFWKRYIRKLNQPGHRIKSWARKASYSKRGRKLARHPAGKKAAKLCHGAARA

SEQ ID NO: 3317 - protein, 25 aa, synthetic construct
KFRMLRKWLKFLRQAAQKANPLWRF

SEQ ID NO: 3318 - protein, 40 aa, synthetic construct
WLKFLPRWIKLITPFLAHKHGRRLQLRKRLATRAMKASWR

SEQ ID NO: 3319 - protein, 90 aa, synthetic construct
KLRYLKKLIKRLSKAHRRAQPIRAVRAWYHSKHAVWRGNARKSKCDLMRKLRKTKATLPILIKRSNRFKMIHKPVLRLLGLKTIAAKTLQ

SEQ ID NO: 3320 - protein, 34 aa, synthetic construct
KWKFWKKWIKWLQTAQARLALAGLKAKNKIKAVC

SEQ ID NO: 3321 - protein, 54 aa, synthetic construct
RLKLYPKFYRLLRRLLKLAHRKALTLPPTDHWKHKAKWLFLLNFWRRAMWLKIA

SEQ ID NO: 3322 - protein, 40 aa, synthetic construct
KMKYMRRMFKKLRRANDKNARLKILYGCLDKQNLKLWAII

SEQ ID NO: 3323 - protein, 49 aa, synthetic construct
KFKLLRRFFRKMRTVPLTAARVIAKYKPAFFHRTYAWKKKARRLLLARL

SEQ ID NO: 3324 - protein, 26 aa, synthetic construct
YLRWYRKLLKRLHKLLNEFDRGKACR

SEQ ID NO: 3325 - protein, 24 aa, synthetic construct
LFKLIRKWWRRLKRDLAEKLMRLY

SEQ ID NO: 3326 - protein, 35 aa, synthetic construct
FLKLLKRLYKRIHKLGGKWQLCSKLVGFLMKIAKA

SEQ ID NO: 3327 - protein, 27 aa, synthetic construct
KYRLLCRLLKLWKCHRAMKWDKCSATK

SEQ ID NO: 3328 - protein, 75 aa, synthetic construct
RFKIMKKYWKRLRRAKNRSMMSMKNLRKLAAAELFRYAMVRAHETLRAKAAFQCRVARAQYARAHNMYLGKGTRA

SEQ ID NO: 3329 - protein, 69 aa, synthetic construct
KYRYFRRLLKRWNRATDKAARWRFTWCIKAKHVAWLKAWLGVLALFACKERRLLNDMDCAEYLYRRWKA

SEQ ID NO: 3330 - protein, 38 aa, synthetic construct
KIRFYRKILRLMPKCAATCELLKPRAKVAVQALRKRNC

SEQ ID NO: 3331 - protein, 22 aa, synthetic construct
FLRFLKRMLRFLCKTWKANPAL

SEQ ID NO: 3332 - protein, 20 aa, synthetic construct
WIRFLCRIYKLLRTALIDLK

SEQ ID NO: 3333 - protein, 74 aa, synthetic construct
RFRMLNKFLRRFHPALTDRKAKKMCFAAPTMHRRRLAARLKENFVKYDLKHRLQGRKELNVACLAKTRKVAMNR

SEQ ID NO: 3334 - protein, 51 aa, synthetic construct
KMKLLRKLFRKFSRLAALQIRPRLLRWWNKWRPLWALGLPDPKMHRIRNYR

SEQ ID NO: 3335 - protein, 22 aa, synthetic construct
KWKIYHKILKRLRNALWIVLLK

SEQ ID NO: 3336 - protein, 66 aa, synthetic construct
RFRIFQRLLRLLHTAGKSVQALPRTLLRLTGYALAKKRQPQRLKLRMAHARLMVAVLIKLKNFKYE

SEQ ID NO: 3337 - protein, 67 aa, synthetic construct
KYKLFKKFFKKLNRRAQVRAKLKKIYLSALAERQMLQRNQWAALLAYRLKKEHSKKYFPPRDMTVKK

SEQ ID NO: 3338 - protein, 36 aa, synthetic construct
RIKLLKKLLKRLRPIAKYKGLWPADWLRDAQLIADA

SEQ ID NO: 3339 - protein, 50 aa, synthetic construct
RMKWYQKYLKFLKREILKKHRLIMKRAAWAAAAIRWNKAWKILWCLNRDR

SEQ ID NO: 3340 - protein, 49 aa, synthetic construct
KWKILRRLLKKWKNKAPAAGPHATWYHYAKQYLRWRWRKADWKKWGHAL

SEQ ID NO: 3341 - protein, 56 aa, synthetic construct
FWRMFQKLLRLLPKRAARVQLAHRKDMATKKMQANKLMRAGRKFTLKDLLRIKIYM

SEQ ID NO: 3342 - protein, 42 aa, synthetic construct
KIRFIKKMYKKLNCLVAAAAARRARAAADARMCPNKAKERRL

SEQ ID NO: 3343 - protein, 34 aa, synthetic construct
RLRMLPRWFKKLKKGKTQLITRAKLKAANAIRCC

SEQ ID NO: 3344 - protein, 33 aa, synthetic construct
KWKYYPRFLKYMRKIRAGAPKLRIRTNLLARSA

SEQ ID NO: 3345 - protein, 67 aa, synthetic construct
LFRLIRKFMRKYRRVEDRFFLRKRLHLWLLLRWVDWLSKRVLASMMGKIDRALFGRAEKYRMLLLAH

SEQ ID NO: 3346 - protein, 21 aa, synthetic construct
RWRYMKKLLKFLKTAWTCKAN

SEQ ID NO: 3347 - protein, 32 aa, synthetic construct
KLKFMRKYLRWLKRANAYLKIPSAKCKLFTEL

SEQ ID NO: 3348 - protein, 54 aa, synthetic construct
KWKLLNKMFRIFKKALAARKLLLAGGDQKYLTPARLVLIQKSCHQNKLHAARDR

SEQ ID NO: 3349 - protein, 59 aa, synthetic construct
KFKLFKKFIRLMKKAARETWNHAAHATRFLRYAYLKLKLKAISLKKVHAATRAKKWDIQ

SEQ ID NO: 3350 - protein, 31 aa, synthetic construct
LYKILRRLLKLLRKKIMFRGHGFGVKAICLR

SEQ ID NO: 3351 - protein, 40 aa, synthetic construct
YWKWLHRFLKRIRTLNKRVARERLHKLYLQLPRFLFKMDA

SEQ ID NO: 3352 - protein, 22 aa, synthetic construct
KLKFMRKFIRMFRQKAAAWLWA

SEQ ID NO: 3353 - protein, 69 aa, synthetic construct
RLKWLTKLLKRYKKATTKQMRRKYYRAFQRKERACRCLTQQDTLNLPCPWARKAILQKAAAVRKHSCYR

SEQ ID NO: 3354 - protein, 23 aa, synthetic construct
RLRFIHKWFRRLRNGLKAFALLR

SEQ ID NO: 3355 - protein, 41 aa, synthetic construct
RFKLLNKLYRRWRRAKLMGLRLLLRLHYLFHQKNLKLMRRL

SEQ ID NO: 3356 - protein, 72 aa, synthetic construct
KLRFFRKFIRMLPKTKDRRLYAPAERLTLHLRRNLRARRMIMKLKLGALCIPGCTLKLAIRCRRKKASNRDW

SEQ ID NO: 3357 - protein, 47 aa, synthetic construct
FFRLIRKYMRYLRSQRSQYNAARGRLAPLLKCLKWFTAVVLTALRLA

SEQ ID NO: 3358 - protein, 44 aa, synthetic construct
RLKMLRKFFRYLKRKLKLAIRGGERNDHAAKLDAPVQCNATYRL

SEQ ID NO: 3359 - protein, 40 aa, synthetic construct
LIRLIKRLLKRWSSSRLLCKRTTVAVSQAFRLLKRKKDPA

SEQ ID NO: 3360 - protein, 21 aa, synthetic construct
LWKMLRRLLRKLNKILAEKRR

SEQ ID NO: 3361 - protein, 36 aa, synthetic construct
LMKLLKRIFRKWRRQVCWAAAGLKSCMKAHRADGAL

SEQ ID NO: 3362 - protein, 53 aa, synthetic construct
KFKYIKKLWKRWKKTARTKKSLFKIGALFTLKYGLAMTAKKNRKLALASGFAW

SEQ ID NO: 3363 - protein, 44 aa, synthetic construct
WLRLWPKLLKRLKKCWRLRLAAKMHRKFACKIERMHSPKALFSY

SEQ ID NO: 3364 - protein, 38 aa, synthetic construct
KFKLIKRLLRRYRCALQDLLDKWAKRIRYAYCFQEMRQ

SEQ ID NO: 3365 - protein, 97 aa, synthetic construct
RWKLFKKLYRKFPKLIARASKESPDAETVAAFQLATVMFKQAADWALKPNKNLLRTRLAAAANWCLKRNNHFALYNLKKDRKRRSKAPLQNKAKRSN

SEQ ID NO: 3366 - protein, 37 aa, synthetic construct
KLRILKKMMKWLQTLAPIPSKALRKSLKVKRLKLDNF

SEQ ID NO: 3367 - protein, 25 aa, synthetic construct
KFRLFTRFLKFLRKAPDAKNRQGGA

SEQ ID NO: 3368 - protein, 35 aa, synthetic construct
RWKLLKRLFKRLHKFATAAAVLRWMRLKPRLWWTV

SEQ ID NO: 3369 - protein, 83 aa, synthetic construct
RFKFLKKLWRFYKTETSAHAVAAMCMLYLRKQKQLWFAKHDLLLLLSKPFFLGLWDLAMLLYARKWKRLGKVAALQRAKKMNF

SEQ ID NO: 3370 - protein, 32 aa, synthetic construct
RYRWFRRFLKKFRRAMLNKFRVLSVARTLALE

SEQ ID NO: 3371 - protein, 32 aa, synthetic construct
IFKYMKKWLKLITHKYLKDSAGRALKAARVKA

SEQ ID NO: 3372 - protein, 56 aa, synthetic construct
KLRYFRKIFKLIRKPQALALKAAKKYLDKVQRRAMWRQTLRAFWGVKAFANTKKCA

SEQ ID NO: 3373 - protein, 69 aa, synthetic construct
LLKLLRRWWKWMRRIARHLGCVCLLGRKNQKRVQLPYNYVKMTKAAALSMRKLRTPTAKVLAEDPAARA

SEQ ID NO: 3374 - protein, 27 aa, synthetic construct
RYRLYNRFIRLLKKKFSQHARAELAQM

SEQ ID NO: 3375 - protein, 66 aa, synthetic construct
KMRFFQRFWKRYRKLLPAYIKRLWATKGDLVILNRRLRERRRLAQLHTASLSLASKIRPKSFRAFA

SEQ ID NO: 3376 - protein, 34 aa, synthetic construct
RFRIFRKWLKILKKCAVLQGKFIYTRDAALLRRG

SEQ ID NO: 3377 - protein, 72 aa, synthetic construct
LIKFWNKWLKKYKTKLSANAGRENKKMLLMMFANALQLRLKSKKLFLLCFALIHVRLRACRWRADRRKCRIE

SEQ ID NO: 3378 - protein, 23 aa, synthetic construct
RLRLLTKMLKRINRAEKAHCVIW

SEQ ID NO: 3379 - protein, 27 aa, synthetic construct
KLRFYQKLMRRLKRARKALTLAARKRL

SEQ ID NO: 3380 - protein, 36 aa, synthetic construct
KFRIFSRLLRLLQSWPRIFLAAAKYHGRLWKLDKAN

SEQ ID NO: 3381 - protein, 20 aa, synthetic construct
FLKFLRRMLRKYPKAHEQKL

SEQ ID NO: 3382 - protein, 85 aa, synthetic construct
FIKWFKKLWKKLTRCWRALACSGRWETFWKRVKKALYAARLYYMARVLPALCARGYLKTRGMDAKRRYSTRDLYRKWALKVLLWL

SEQ ID NO: 3383 - protein, 20 aa, synthetic construct
LLKYITRLLKKWHKEANCKK

SEQ ID NO: 3384 - protein, 41 aa, synthetic construct
MLKYYSKFLRRLRKHPLKKAFVKLAEPAKQVGYAAFPLLRI

SEQ ID NO: 3385 - protein, 20 aa, synthetic construct
KFKLWKKLLRWFSTRGAQLR

SEQ ID NO: 3386 - protein, 29 aa, synthetic construct
FMRWWQRLMKKYRRQLKAIQALLNAHARL

SEQ ID NO: 3387 - protein, 41 aa, synthetic construct
YLKYFKRFYRKITCMRHGKAARAVLYSARRAAASLSASAVK

SEQ ID NO: 3388 - protein, 25 aa, synthetic construct
KLKMFRRLFKMFQRHHLKQDKASAL

SEQ ID NO: 3389 - protein, 66 aa, synthetic construct
IFKYMSKMLKKMSRTWFLLSGPLRHKNWLLRLARRKAELALRQNRGCQLIAHPLKLRARAKAIRKA

SEQ ID NO: 3390 - protein, 23 aa, synthetic construct
FFKIFHRFLRLLRKRGSRLYNLA

SEQ ID NO: 3391 - protein, 46 aa, synthetic construct
RLRWYQKWLKIFHRLPNQKMHAKKLKFIAAASNAQLLKHRRLIKRK

SEQ ID NO: 3392 - protein, 96 aa, synthetic construct
KFRILTRLLRRWKRGGRNKHAGREYRAPRKRALKFGAWCYKGLKQLLLALQLLFHLTLGILERRERRRKKLCHLSRDRKAQDHRQEKMDVVILNDR

SEQ ID NO: 3393 - protein, 37 aa, synthetic construct
LFKMYKKFYKRYRRMRAYFVPAACWKRLLLKLNAALT

SEQ ID NO: 3394 - protein, 41 aa, synthetic construct
FYKIWRRIWKFLKRAFLKEAYAAAKLGACIHKKNLIPRAMK

SEQ ID NO: 3395 - protein, 46 aa, synthetic construct
ILRLYTRLLKWLRSARKRLLARLLKMTCKGAAKSKKADNLIKPWAY

SEQ ID NO: 3396 - protein, 32 aa, synthetic construct
RLRIFRRLIRKFCKRTLKLATKARLAAWECLA

SEQ ID NO: 3397 - protein, 70 aa, synthetic construct
LMRIYRKFLRLLHKWQFRLECARKRCKAKRFIADCDYLPAYRAAIRAAEAKKAFLALKLEIKEKLYWFEA

SEQ ID NO: 3398 - protein, 71 aa, synthetic construct
KLKFIQRILKRFKKLKYTWARGLTTLIRACDKKSLLARADHFAGAPKKDKANADMWILRFHRKRKRMALAL

SEQ ID NO: 3399 - protein, 71 aa, synthetic construct
LLRLLKKFLKKLRRTRLLMLIVRLVLALRHRRLRNVAWKDWKAKKHCSHSLKCDNKEPRENLKKLNLSSKC

SEQ ID NO: 3400 - protein, 26 aa, synthetic construct
KWKLLNKFMRLYRSWSALPAKRADWR

SEQ ID NO: 3401 - protein, 50 aa, synthetic construct
FLRLFPRYLRRFHKAYAHCARLKAWIAAMALRTEKLRLRLTRAMRRKRRQ

SEQ ID NO: 3402 - protein, 32 aa, synthetic construct
LFRLIKKYLRRWNTAIAKKRQGRYRLTAGALL

SEQ ID NO: 3403 - protein, 30 aa, synthetic construct
LLRFMSKMIRKWKRRLAYIWLKHACKARHG

SEQ ID NO: 3404 - protein, 56 aa, synthetic construct
KMRMMTRLWKWLHRSKARRRFSKYLRAKAKRSRDALASANSALANNREMALDHLAV

SEQ ID NO: 3405 - protein, 56 aa, synthetic construct
LLKIMKKIMRLLHRSMKIKQAYAFVWAYAYATMHKARRMKKPILAEKHRKQLARLQ

SEQ ID NO: 3406 - protein, 62 aa, synthetic construct
KLKFMRRLFKRFRPCALIYLNLKRRAALYDWSRGAAKFLWLPLWKKVRPMCWRIRDKALTLG

SEQ ID NO: 3407 - protein, 28 aa, synthetic construct
LYRLLTKYIRRIQPMTARYLKLRRKKAA

SEQ ID NO: 3408 - protein, 29 aa, synthetic construct
WWRLFSKIIRKLCKPRELAAEASQKKACR

SEQ ID NO: 3409 - protein, 81 aa, synthetic construct
FWKMIRKWFRRYQKLRCACLRKHIMAVYRARRQRLGARAKPQMMKLCKFAYSLALSRLAFAGDAQKFLAIKAMARRWLRRN

SEQ ID NO: 3410 - protein, 69 aa, synthetic construct
LLRFIKKLYRKLRRLMKPWMHIKSILILKDAPLAHLRRVLKWKGANAKCHKKRQMRRCPAGNDATACLL

SEQ ID NO: 3411 - protein, 33 aa, synthetic construct
KLKIFRRWYKRLQKALLLGDRANRKRLRRLLWP

SEQ ID NO: 3412 - protein, 47 aa, synthetic construct
WFKMYTRYLKKMKKGLGNAAAESLKTAQRDKILAFHKRQKLKAELRP

SEQ ID NO: 3413 - protein, 39 aa, synthetic construct
LFRFLHRFMRRFHKLLCAVKKMALKNSFRKADLARSPLA

SEQ ID NO: 3414 - protein, 32 aa, synthetic construct
WLKYLQKWLKRFTRGCRYAPRAALSAKAMHAI

SEQ ID NO: 3415 - protein, 21 aa, synthetic construct
LIRMFRRYLRMLRQNRANRHL

SEQ ID NO: 3416 - protein, 59 aa, synthetic construct
RFKWIRRFMRMWRKDRKLKLQNYYAQGHNRLRWRKALRLSALGNWKAELKWAKLMLRLK

SEQ ID NO: 3417 - protein, 20 aa, synthetic construct
ILKIFPKLFKKLKPCLLAKR

SEQ ID NO: 3418 - protein, 53 aa, synthetic construct
RIKIIKKWLKKINRRPLLVQADNRPIFMLWKALWLNPKLRTAAWMLKLLRRKK

SEQ ID NO: 3419 - protein, 55 aa, synthetic construct
RLRMLQKMLKRWSPLLPLEKSSKRKARAALKRAKSSSRKDWGAHPLRLKAHKTHE

SEQ ID NO: 3420 - protein, 20 aa, synthetic construct
KYKFFRRILRLMKRHIASLL

SEQ ID NO: 3421 - protein, 39 aa, synthetic construct
WMKWMKRMLKRLQCQATKRLALATLNRRLMLKKAHPGSD

SEQ ID NO: 3422 - protein, 72 aa, synthetic construct
IWKLLKRWLRRLTKLPNNPRKRRKNNLRQKPRRKLYAILKLLKKWVNPAAKHMKQRADNEKCGKAFYGAAIY

SEQ ID NO: 3423 - protein, 20 aa, synthetic construct
FLRYLTRLYKKLTNARSKTL

SEQ ID NO: 3424 - protein, 25 aa, synthetic construct
RMRLMCKLWKMWNRARLIAWASKGR

SEQ ID NO: 3425 - protein, 75 aa, synthetic construct
WYKFLTRYLKWLRRCKLGRERKSGTYKNWACLRRREKSTPNLYYLSATAQAALAKRAKTAKRRADAAGPRAWPAR

SEQ ID NO: 3426 - protein, 29 aa, synthetic construct
KIKLLQKFLKFFCPTSKSANAKALKVRMR

SEQ ID NO: 3427 - protein, 67 aa, synthetic construct
KLRLLKKYYRIIRKLKLKSKREFKAVLRRILQALDFAPALPWATRDKLNLKCYDMQCYNPRRIAVRL

SEQ ID NO: 3428 - protein, 24 aa, synthetic construct
LFKWMTKLIRKICKARDLDRAKNL

SEQ ID NO: 3429 - protein, 35 aa, synthetic construct
RLRLYKRYFRKFRQSTFPHKIALLMQIKRAKALLR

SEQ ID NO: 3430 - protein, 30 aa, synthetic construct
KMRMLQRYIKLWRRAALAKECREHLARRWM

SEQ ID NO: 3431 - protein, 40 aa, synthetic construct
RLRMMCKLLRKYRKFKLKLWHRAHNLHLLKQLEWLRADQQ

SEQ ID NO: 3432 - protein, 25 aa, synthetic construct
LIKILRKMLRYFKPRLSVIALKCKL

SEQ ID NO: 3433 - protein, 27 aa, synthetic construct
LIKLYTKLLKYLCKRAASEYDVKLRYL

SEQ ID NO: 3434 - protein, 43 aa, synthetic construct
LYRWFKRFIKFLKRNNLARLNYMSKRFLARMCCAAKPCAPAKK

SEQ ID NO: 3435 - protein, 43 aa, synthetic construct
RLKLFRKWIKKFKSAAMLDVKAMRILVERTLNLRKLMSTLLGY

SEQ ID NO: 3436 - protein, 46 aa, synthetic construct
RLKFWCKLLRKFKKFIPGAPLLQANLKYLAWRKKMLRKHSGDLAWE

SEQ ID NO: 3437 - protein, 53 aa, synthetic construct
KLKLLPRLLRKIKKLKRNLVPDWALVGSAIAATMKMRRLLKTLKWNSLKVLLP

SEQ ID NO: 3438 - protein, 20 aa, synthetic construct
KYRIFSRLIKRLRTAIAAMR

SEQ ID NO: 3439 - protein, 37 aa, synthetic construct
FWRLLRRLLRWFRKLPKRKKLLKNANEGHCAELHKIV

SEQ ID NO: 3440 - protein, 33 aa, synthetic construct
LLKLFKRLLRRWNKQRFKALYAFKMHHGHLLAI

SEQ ID NO: 3441 - protein, 43 aa, synthetic construct
FIKFLRKMWRKFKKYGEKLLLQYKRIKLKATAKKGNALWLAAA

SEQ ID NO: 3442 - protein, 100 aa, synthetic construct
RLRLYSRLLKRLPKRDTWLLCRLLLENLVRKQAWKMELLTFIKCEAERSVENRRAQNALCNEKLRIKYTKKMAHSCLRLQWAQQENDVLRRRNALARLRL

SEQ ID NO: 3443 - protein, 66 aa, synthetic construct
KYKMFNKIFRIMKKANLKWPLLALAKMELAFKKAQRPRMPKKYRRDLLDSRNIRLYNAKCLAWHRK

SEQ ID NO: 3444 - protein, 32 aa, synthetic construct
RFRYMHKLLKRYPHKKDTKAEASCLKAHRLAF

SEQ ID NO: 3445 - protein, 29 aa, synthetic construct
RIKYMRKMYRLLKTRVLILKTARCALARV

SEQ ID NO: 3446 - protein, 74 aa, synthetic construct
KFRYMKKLWRKFKRWTLRLGVRAKYRKRYVVKCWLKMRYDECVPLKLALAKASLRAQSIRKWSNASNCTKLLAR

SEQ ID NO: 3447 - protein, 33 aa, synthetic construct
LMKMMRKLIRRLCRRLRKKAAWGDALVGSDRSL

SEQ ID NO: 3448 - protein, 23 aa, synthetic construct
LLRLLNKLWRYLHRLTRHLTCRK

SEQ ID NO: 3449 - protein, 70 aa, synthetic construct
MLKMIRRLYRYFRPTMKFLRLSKALRSRIRKRLGIEGFRRWKAKNLLLAKREGKAAILWLNKALTNPWFE

SEQ ID NO: 3450 - protein, 52 aa, synthetic construct
LFKFMKRLLRKLQTDALLPAESAKGNKMARVLVAKAAMWERLSTFLLFRTKF

SEQ ID NO: 3451 - protein, 71 aa, synthetic construct
RLKLLHRFFKIYKRAKNDNHKCYRAELENDHGALRRLFRRRLLASKKYALACLFKLRAGKHVGLYHKRFIF

SEQ ID NO: 3452 - protein, 68 aa, synthetic construct
RLKLLSRLYKLWKQPLAKKPKLAWVQPAWLFFWKLKLHADDQKLKVFLGISKGNYACKMRRQRKKLAP

SEQ ID NO: 3453 - protein, 24 aa, synthetic construct
WFRYLRRYLKKLKTSLMQKLRVIL

SEQ ID NO: 3454 - protein, 27 aa, synthetic construct
KLRWMRRLFRLYRQLHLIAGGNWLERA

SEQ ID NO: 3455 - protein, 34 aa, synthetic construct
RLRLLKRFYKIMRRHNDITSAKLAISKLEMLKHA

SEQ ID NO: 3456 - protein, 88 aa, synthetic construct
RIRFYTKFWRRFTCLAKNWKQRLLLALRAPQKQMACKCRRKAEKKRNISALQLPARIGCRLRKACADKVFKLIYIARNLIEQDARKKK

SEQ ID NO: 3457 - protein, 23 aa, synthetic construct
LIKLLNKMWKYLQRKKARCVNIL

SEQ ID NO: 3458 - protein, 26 aa, synthetic construct
LMRFLKKLLKRMNRAALNRLNLGMKY

SEQ ID NO: 3459 - protein, 78 aa, synthetic construct
LYRLLRRIIRRWRKRGACALQKRLSLVKKLKTWASIEAVALAAARKVMLQHQRKFAAIKSFEVCAKTCKNSIVMLNKR

SEQ ID NO: 3460 - protein, 45 aa, synthetic construct
RFKLWNKMIKFINKKRPAKFKRLALCVCRPTAAQFLLAILAAERC

SEQ ID NO: 3461 - protein, 92 aa, synthetic construct
RIRLIRKWLKRMTKRQLPLFFNAKGGKRAGLMKKAPIDPALALWNLEGRARAPFQRKDEPLAARKVVRKAKKAEKRFGNLKKLNMRQLPLRK

SEQ ID NO: 3462 - protein, 45 aa, synthetic construct
RIRLYQRLFKKWCHAPNGKRNGTKKCKLAWLRMALKPQKQKTLLL

SEQ ID NO: 3463 - protein, 32 aa, synthetic construct
KLRLLRKLFKWFHKVIRLVAWKNQRIYKAMAS

SEQ ID NO: 3464 - protein, 29 aa, synthetic construct
ILKFLCKLFKMYRQGQTPKRCKAQKLKAL

SEQ ID NO: 3465 - protein, 34 aa, synthetic construct
YMRLLRKLFRKLNKVVLKPCRLAWLHAHRGKFWN

SEQ ID NO: 3466 - protein, 21 aa, synthetic construct
KLRLWKKLLKRFCPNLTWRLR

SEQ ID NO: 3467 - protein, 66 aa, synthetic construct
KFKFWKKWLRKLKRKRLACKTAAHMAKLRQCEPPWGSRPARIEEFNVRNKELWLLLLLIRLNLRAL

SEQ ID NO: 3468 - protein, 79 aa, synthetic construct
KYRFLKRLLRLFSKLHITVTLARNRPKVMLHHAQFKKEKTDEKQLWERAATKVHNLLGRGCSAIAKKKKAGLKEKLAKA

SEQ ID NO: 3469 - protein, 51 aa, synthetic construct
KLKLLRKLLRLISKTNKMMRELLTFARRAKRLYKCWLMQCIYKRNRQMKFQ

SEQ ID NO: 3470 - protein, 56 aa, synthetic construct
LLKWYCKFWKFFRCNRRPKLLAIHQKLNLNAKALIKALARRHAIMLKHLKKNKAPF

SEQ ID NO: 3471 - protein, 32 aa, synthetic construct
FLRLLRRLYRIWKRYLAVNRLKLWRSSCLAWA

SEQ ID NO: 3472 - protein, 55 aa, synthetic construct
WFRLLKRLIKRIRPWRYKARAIRATAKAKKLKLELVKQRCDLRRLLLQKFCIRPL

SEQ ID NO: 3473 - protein, 22 aa, synthetic construct
LIKILKRLWKRLRPMHLAKALI

SEQ ID NO: 3474 - protein, 22 aa, synthetic construct
FLRLWKKLMRRLRSRKAQAAAY

SEQ ID NO: 3475 - protein, 99 aa, synthetic construct
RMRFMKRIYRKWRRALLLKQAAARRKDKLFRNKSKRFKMVNLRNTFLPRRATQKYNAMLVPTRKKHHCKANMLRLAALKQRHEPWAAKRLLCLRGKAIH

SEQ ID NO: 3476 - protein, 23 aa, synthetic construct
KYKLFQKFLRFLRSCLRLISLNL

SEQ ID NO: 3477 - protein, 36 aa, synthetic construct
KLRLLSKFYRLMSKRQLRLPLHKWFDILLHLRARKK

SEQ ID NO: 3478 - protein, 44 aa, synthetic construct
KLRYFRRWMRMIHRRAAFRKDKCVFTAALPLLKEAMYKALNHLK

SEQ ID NO: 3479 - protein, 86 aa, synthetic construct
RMRLWQKYYKYFRPAKKRKERTGKRKNATSKAEQAKFTAMPLRLKLLRALWECLLCRLVCPYRGARRKIYGGKNRRQTAEAARAAL

SEQ ID NO: 3480 - protein, 58 aa, synthetic construct
RFKMLCRYLRIMRNACGGDWKLVAARMRDAAFKQLNRRMKHLQELAGVRDRKKAKLKV

SEQ ID NO: 3481 - protein, 41 aa, synthetic construct
KIRMLKKWLKKLKRALAQFKSPGENRWRCCRAPKLHCLAAT

SEQ ID NO: 3482 - protein, 25 aa, synthetic construct
LYRLFPRYLKKLRHFTIKDRNRLLL

SEQ ID NO: 3483 - protein, 38 aa, synthetic construct
KMKFWCKLIKFLRRLHLRKWNAYGLEKLEKVADAPLLQ

SEQ ID NO: 3484 - protein, 65 aa, synthetic construct
IYKLLNRLLRKWCKRTIHADKDALAQLSLARAAKRRGMAARALELTDAKRQTNPYQNDQAKRLHG

SEQ ID NO: 3485 - protein, 37 aa, synthetic construct
RMRLLKRWWRKLRRYKAARSAEAPRESRMKIAGLDLQ

SEQ ID NO: 3486 - protein, 34 aa, synthetic construct
KLRFFKRLLKRYQRVFRAWKLTADQAPRRLDAKL

SEQ ID NO: 3487 - protein, 20 aa, synthetic construct
WIKILNRIFRRLKPAYRCAA

SEQ ID NO: 3488 - protein, 42 aa, synthetic construct
FIRLFRKILKFLKKKALLKFRDARQDRPCAGSRRAPEIKAPL

SEQ ID NO: 3489 - protein, 26 aa, synthetic construct
KLRLMKKLLRRFPRLACCRYLPACNN

SEQ ID NO: 3490 - protein, 48 aa, synthetic construct
KYKMIKKYLKWITQALSKKARTRRCRMRLACLPRELATLARVHADTML

SEQ ID NO: 3491 - protein, 64 aa, synthetic construct
KLRLYNKFLKKFKKTAKLCLDCRLHNKSHKLIALKMRAFKNKGAYKRACKLSFGAWLYYRLILD

SEQ ID NO: 3492 - protein, 22 aa, synthetic construct
YLKLLKRLYRRWCRHKWCLTNL

SEQ ID NO: 3493 - protein, 50 aa, synthetic construct
KLKWMPRLLRKFNKLDDAQRRRLSCLLSKKLTMARDHHHMLHRQRLRLYA

SEQ ID NO: 3494 - protein, 42 aa, synthetic construct
IFRLITKLFKKFRKIRRPKQPRKRLLGAGLCAAIATHQARLE

SEQ ID NO: 3495 - protein, 54 aa, synthetic construct
KFRYFPRFYRLLRNKIELAKKLYKAKARLLRMLDCVIYCEKGHKDAKQSRARLW

SEQ ID NO: 3496 - protein, 41 aa, synthetic construct
RYKILRRLFKLMKRALLENRRIICKDFHACAASNAAQAMMR

SEQ ID NO: 3497 - protein, 50 aa, synthetic construct
KFRFMKKLFKRYCRARLHLKRKKGAGQAHLKYPLVSRIVRWRYLAKAMLA

SEQ ID NO: 3498 - protein, 23 aa, synthetic construct
RLKIYKRILKFLCCCENLLNARK

SEQ ID NO: 3499 - protein, 41 aa, synthetic construct
KYRLIKRWYKRLKPAKNKLFKEAFARPWRKAAHARLAANLT

SEQ ID NO: 3500 - protein, 41 aa, synthetic construct
LLRYLRRLYKMWCCLKRARARKALTAAYKYSRQVVVWLYKA

SEQ ID NO: 3501 - protein, 89 aa, synthetic construct
RYKYLCRLFRYLKCAGLQAIWRQAHRAHGCPAKLPRTADKKLRQNKRAWWYGVRKMCHARARLLRAHIRIPKTREMRRDLLLFGAPRAL

SEQ ID NO: 3502 - protein, 52 aa, synthetic construct
RFKWLRKLWRLLRREPKIQYPLIAIKKRCHHLYEAKHELALSNARWKCAALV

SEQ ID NO: 3503 - protein, 36 aa, synthetic construct
IWKLYTKMLKKYHKYCALKCVALHRWRKAKWARVLP

SEQ ID NO: 3504 - protein, 65 aa, synthetic construct
KLKFIPKYLKYYPRAHPVKENAVRYRALKLYSLMGQFRLKAKWLFLQAKRHRKKVARLARAHLLC

SEQ ID NO: 3505 - protein, 22 aa, synthetic construct
KFKYLKRYLRRLPHAALDGAAG

SEQ ID NO: 3506 - protein, 44 aa, synthetic construct
KMKLFKKWYKRLQRCAKGGKAKKIFAIAFYSAMALAKIERLRTA

SEQ ID NO: 3507 - protein, 22 aa, synthetic construct
KLRLFKRLLRYLKCNATAMGRT

SEQ ID NO: 3508 - protein, 38 aa, synthetic construct
FLKMFKRLIRKFSQLRYLLARAAEGLAMASRMVLRQRK

SEQ ID NO: 3509 - protein, 100 aa, synthetic construct
LLRFYTRFMRRLRSEKLQGFIERFFARAKLNASLIHKREVDAAGQATCHWELLRLRKKKRKVRACKIAKRRRNKALLDNELCLALLLRYEALEMKECAAK

SEQ ID NO: 3510 - protein, 50 aa, synthetic construct
FLKWLPRLLRKLRKNTARKLTALDRKKFQLRRELRSCRRAQVWEAIEDFT

SEQ ID NO: 3511 - protein, 44 aa, synthetic construct
RWKFLRKYYRWWKCGTAWQSVRAKYYMCQLALKKAKARKLKAYA

SEQ ID NO: 3512 - protein, 86 aa, synthetic construct
WLRFLKKILRLLPCRKELYFKRRAPFLRHIAIRQMAAAPGLLKKAALLRMRRCWPALRRKWAECAAILQKRSVHFDYKQVLHLKGK

SEQ ID NO: 3513 - protein, 60 aa, synthetic construct
KFRLLPRYLRWYRSRARYALEGYLRGKLMKRRFRKHLFKQKAKVIVLLMMALLLMAEVES

SEQ ID NO: 3514 - protein, 30 aa, synthetic construct
RIKMLTKFLRWMKRYLMAPKRLLVDRLHLK

SEQ ID NO: 3515 - protein, 38 aa, synthetic construct
KMRLYKKLLRIYKTFKFMTLRGACANRLASKLNNNCLK

SEQ ID NO: 3516 - protein, 64 aa, synthetic construct
RLKMLTKIFRKLHQKYRSKRRALAKFCALARWFKRLRLRHFAQRRQSTLDREAFWIVKSRGCIL

SEQ ID NO: 3517 - protein, 35 aa, synthetic construct
RMKLFQRYLRKFPNRLLNACKQQRAGLDELLRAKK

SEQ ID NO: 3518 - protein, 77 aa, synthetic construct
RYRWFPRYIKLLKKLDRARPACDYKKSCKLLGKKSPVARWTKAIKLVYLKGMRRLAKLLHPRCAKLLAKLQAAPVHA

SEQ ID NO: 3519 - protein, 42 aa, synthetic construct
RIKLLKKLIKKLQKMSAYRRRQALRIILRAVAALIRLLPKNG

SEQ ID NO: 3520 - protein, 94 aa, synthetic construct
KLRFFRKMLKKLKTHFLVRECRKERAIRLRQNNFLTRAACRGASKKNFARFWDKRAARQLARTGSRLTKATLNLFAAQLECSRPDKLREQKVAI

SEQ ID NO: 3521 - protein, 37 aa, synthetic construct
KYRLYKRYLRRLRKLLHRRQKFLMLLFDENAWYASLG

SEQ ID NO: 3522 - protein, 33 aa, synthetic construct
RIKILHKLWRRWHKMLLLSVDNRPLAAIKQLAR

SEQ ID NO: 3523 - protein, 29 aa, synthetic construct
RLKMMQRWLRRLNQKAALFDHLLVKSDQR

SEQ ID NO: 3524 - protein, 23 aa, synthetic construct
LLRLMNRFWRRFRRALLAARRPG

SEQ ID NO: 3525 - protein, 69 aa, synthetic construct
RMKLWKKLYRFFKQLEMPALSKKRALLAKMCFRKMLRYCLDQHALFLHKRNMTLNDRLFLKLWTKARTW

SEQ ID NO: 3526 - protein, 56 aa, synthetic construct
KLKYYKKFLRRYCHRKLFRWLTSLRRAARKALLNYHQVCQLLKKKKMMATWKNHCL

SEQ ID NO: 3527 - protein, 32 aa, synthetic construct
RFRMWRKLLRRWSPLKAVIHAALRYVSARACR

SEQ ID NO: 3528 - protein, 82 aa, synthetic construct
KLRFFQKIMKRYQSRLRLEAVKNAVIRPGLMRYRDLRRLLAFYLKRYLKRSNILWLKVMAASIRRAIKHRRTPLSLNRKLAI

SEQ ID NO: 3529 - protein, 33 aa, synthetic construct
KLRFFRRFFKLYKHFHAAKAKGIAKVDLLDLGL

SEQ ID NO: 3530 - protein, 78 aa, synthetic construct
RFKIYQKLIRRIKTLAVLAAARTAINAAVLCRALKTKAKRKAAFIRLANPMKLNMSHKIAMKWPVMALRMRKAGHRQR

SEQ ID NO: 3531 - protein, 34 aa, synthetic construct
RLKYWKKLWKKLRRWGGRKPLLCYTLGYYCAAKD

SEQ ID NO: 3532 - protein, 73 aa, synthetic construct
FWRLLRRLMRKLKQKSHAKRIQLRAHKIKRPIKLKAGWPRFMKDKMFAKWADQILINAIVQKAYAAAANADAK

SEQ ID NO: 3533 - protein, 97 aa, synthetic construct
KLRILRRFFKKYKTVAAKSMKLCWAAAWDARSPAADKEALNTLDCKAATNHIELSNQHARKMFLGIERLESRKAARLLRRLATWLWLPRDKRQRKKL

SEQ ID NO: 3534 - protein, 27 aa, synthetic construct
LFKFWRKLLRRIQKAAALFKDGRDAYQ

SEQ ID NO: 3535 - protein, 66 aa, synthetic construct
RMRMLRKLFRKIKPKYCRRGAEAAYLKMRHILYKRPETCVLRIRRWKKVMMRLPGAKCKLAAVLLA

SEQ ID NO: 3536 - protein, 44 aa, synthetic construct
KMRFYRRLYKKFRNHNAAARLTRHPANETQQERFAGKRKLLLRL

SEQ ID NO: 3537 - protein, 98 aa, synthetic construct
RMRFWKRLLRIIRKAKAKAKQHNRKADVHAYKKPNGYAAWRNVKERRAAAAVGRCDHHTPLAVLYPVFEKRVIAWALIRPLRLLAWPLAANKKAMKEA

SEQ ID NO: 3538 - protein, 32 aa, synthetic construct
LIRFYRRLLKKMRRRRMHTRTLHRLALDADYL

SEQ ID NO: 3539 - protein, 56 aa, synthetic construct
KLKMFRKLLKRYNCAFQKKMATKVALVALQLLAIVRPLWPKCKKRTKRVKVHRAFL

SEQ ID NO: 3540 - protein, 74 aa, synthetic construct
RMKLFRRFIRILSRFTARARQHRVNLRRLKPLLLRYKCHALSPVMLKACLALMMWKKLMPHKYRKLMARKRNKI

SEQ ID NO: 3541 - protein, 96 aa, synthetic construct
RWRWFRKIFKRWKRSLRRWDAAKWAKSLWARYAKPRALIWHMRPHAKYLHGARKRRGFKRNASRKMIKLMMKARLKDENALEADYKPAIHKLSIAD

SEQ ID NO: 3542 - protein, 36 aa, synthetic construct
RLKYYRKFLKYLCKLRHAPKKRLNAKKIRMAALWVW

SEQ ID NO: 3543 - protein, 27 aa, synthetic construct
RMRLLCKLMKKLRSAKLMWWRDLLRKL

SEQ ID NO: 3544 - protein, 31 aa, synthetic construct
KLKYFRKMLRKWTRWEKLLFRAAAEVDAAAI

SEQ ID NO: 3545 - protein, 41 aa, synthetic construct
KLRFLRKLFKKFRKRAARRASKPVAALGTLRRAPLHHLARA

SEQ ID NO: 3546 - protein, 92 aa, synthetic construct
WLKFFRKFFRRFRSAAITNQRALAAYGLAVANRPSKVEPSKKKAKKCRIWKAAAKAKIDKCAQCAKRMKKLEWKAKLVAKHKKQLLCGAKKI

SEQ ID NO: 3547 - protein, 34 aa, synthetic construct
KLRFWPRFLKLFKKAVFKLIAAKVAKLRRELHMG

SEQ ID NO: 3548 - protein, 23 aa, synthetic construct
RLKIFPKLLKRLTRAPTKTATWK

SEQ ID NO: 3549 - protein, 32 aa, synthetic construct
ILRLLKKFMKKLRSPICACEPAAAMSHKKKLA

SEQ ID NO: 3550 - protein, 70 aa, synthetic construct
MLRLLRKLFKRIKKARWHWGSWKREKAQLLRLPRAKLLFAVTEWVLWKSRGVNRRSLGAAVRQWYKCRPA

SEQ ID NO: 3551 - protein, 89 aa, synthetic construct
RFRWIRRYYKRMRRRRYRLRMKWKFALSRMADLEARCYLWKSKPQLYHHQDLYRRLIRTLKKLFAWKIVKALSCLQILASKHAKKKPLL

SEQ ID NO: 3552 - protein, 54 aa, synthetic construct
RLRMIKKLWKYLNKKAGALMSDLYKFKFLLEARMKRARANNVLTSLLLYDFHTR

SEQ ID NO: 3553 - protein, 42 aa, synthetic construct
KLKFLCRFFKLWRQKQNKLQKAHPNRRQRLQHAKKGLGLTAA

SEQ ID NO: 3554 - protein, 50 aa, synthetic construct
RLKFLRRFYKKMRKARAMRCPKVAKLLCKQRAANLSLQGISSKDVLKIKL

SEQ ID NO: 3555 - protein, 21 aa, synthetic construct
KYRLLRRFLKLFPCLTGRKSE

SEQ ID NO: 3556 - protein, 20 aa, synthetic construct
LYRILRKLLKRMTTATYKAV

SEQ ID NO: 3557 - protein, 27 aa, synthetic construct
FLRYWRRWMRLFRKYARHTLLVTATKL

SEQ ID NO: 3558 - protein, 50 aa, synthetic construct
RLRFFRKWFRKFHSAILLALLVKVVNRALMRRIRAASLFREFDAFHALRM

SEQ ID NO: 3559 - protein, 92 aa, synthetic construct
YFKYLTRFLKYWNRRGIHKAWALAPKALEKAKHNVSLEKKLRLRLTRKVSLALWRHFAVRAIAKARASLALLEDLPIFRYAIHSYWKKRKKK

SEQ ID NO: 3560 - protein, 47 aa, synthetic construct
RLRLWRKMMRLLPKKARHCFGLERKMEQIANAKIAMCKGLAARIAKN

SEQ ID NO: 3561 - protein, 21 aa, synthetic construct
IFKWMRRLFKKYTRQLRLALC

SEQ ID NO: 3562 - protein, 51 aa, synthetic construct
LWRFWRRLWRRLRKRIMALPAEAKYRRFERLCHTCAERRLRTNRKVVLYAV

SEQ ID NO: 3563 - protein, 28 aa, synthetic construct
LYKFYCKLLKLLRKKALFASKRQFLGSR

SEQ ID NO: 3564 - protein, 21 aa, synthetic construct
LWRMYKKLIKRLRQRMQALRA

SEQ ID NO: 3565 - protein, 95 aa, synthetic construct
KYRILKRLIRLMRRNANMRDKARTKTMRKLRMATFLRGLWWAPRMKGALLFTSARRLHTDAWEWSALDREARLHKGFRKKATNLWSAALACRNRK

SEQ ID NO: 3566 - protein, 40 aa, synthetic construct
LFRLLCRWWKKFKKAAAFIGRAKSQKRNLAEAKGGWKKKV

SEQ ID NO: 3567 - protein, 21 aa, synthetic construct
YMRLITRLIKKLRKWLANAPQ

SEQ ID NO: 3568 - protein, 66 aa, synthetic construct
LLRWLKRWYKKWPSRVKPNRIKQAARAKKRHVATSTIRKPMHAKCREARFWGRALTLDQLWRRAAA

SEQ ID NO: 3569 - protein, 95 aa, synthetic construct
WLRMFKRFMKFMKQAFAIVLEKAWNREKLALERKWLKARDKKRPARGREELKKRLVCARVTDARMLNCEKLQAHLALLNAAAGFLFKLAYLMAKA

SEQ ID NO: 3570 - protein, 52 aa, synthetic construct
KLKYMKRWYRRFKHCRLIRRAPKCLLTKLIAALRKCALRHAKCALCAAKRLL

SEQ ID NO: 3571 - protein, 25 aa, synthetic construct
LWRIFQRMYRKFNRLFLLAKDLPKL

SEQ ID NO: 3572 - protein, 69 aa, synthetic construct
FLKFYRRWMRMLKREHSLRCHKQKKSYYSLSKRDKYKRARMLAAKLKLAKSCRRYPRLDIFQTLLFLTL

SEQ ID NO: 3573 - protein, 29 aa, synthetic construct
RMKLLKKLYRWWKKMRCLAALQAARGTKL

SEQ ID NO: 3574 - protein, 25 aa, synthetic construct
RMRLFSKFFRRLKQLRWPILNFAAL

SEQ ID NO: 3575 - protein, 77 aa, synthetic construct
MLKWLNRFLRLFRRKAKGVKGKRTLAMKIHMRAAELRMRDFYIKPPLHRRGKDILMGRAHARAKRMLHHAKIARASH

SEQ ID NO: 3576 - protein, 40 aa, synthetic construct
LWKYMTRILKLYRNYRIYYHIKKADDLKLAKHASKKLRAT

SEQ ID NO: 3577 - protein, 46 aa, synthetic construct
MWKYIKKFYKKYNRALAKLKPRAKVMQATRFLLAKKYTFARLALTG

SEQ ID NO: 3578 - protein, 24 aa, synthetic construct
RLKLIRKMLRKIKHRTSQACAGAA

SEQ ID NO: 3579 - protein, 63 aa, synthetic construct
RLRWLRRFIRKMRNARVHLKLPDKNKRGLRAAKLYMYRYALDSAKIVDSFAAWSCRFLADLKA

SEQ ID NO: 3580 - protein, 43 aa, synthetic construct
RLKFISRFFKKLCKKMALAQALYKAPRRFRTAVIACADAKVLL

SEQ ID NO: 3581 - protein, 22 aa, synthetic construct
RLKLLCRLFRRLRRRQNANIVN

SEQ ID NO: 3582 - protein, 60 aa, synthetic construct
ILRLWKKIFKLLKRRNLQRCLKHCTRARRLVGMFHLEDACAGKAWKKACSRKQNLPAYAA

SEQ ID NO: 3583 - protein, 40 aa, synthetic construct
LLKWLKRWLKLLRKNGYDWWMKALRGPTRLANKRSQKKAM

SEQ ID NO: 3584 - protein, 30 aa, synthetic construct
KWRMFRRLMRLLKTLNKARDHTLAMAGIRR

SEQ ID NO: 3585 - protein, 47 aa, synthetic construct
IFRLLRKLLKRYRQLKRSEQTGRRKDWFFFLARQLALTNRVVKLDLL

SEQ ID NO: 3586 - protein, 56 aa, synthetic construct
RYRFLCKILKLMCHTEGKAIRCRRACRAALLHKVHRKRATLMRKEKKLIDRLCLLK

SEQ ID NO: 3587 - protein, 27 aa, synthetic construct
MIKFWKKYLRFLKQLFRANHLKRLRAG

SEQ ID NO: 3588 - protein, 52 aa, synthetic construct
LIRMMRRLLKKLRRNPDMKAQYALKRVLKLLAAPSHDKNHSALRLFVRRREC

SEQ ID NO: 3589 - protein, 28 aa, synthetic construct
RLRFYKRWWKILHKWCAKSMLRRAAADV

SEQ ID NO: 3590 - protein, 25 aa, synthetic construct
LYKIYRKMLKIINSAWRRILNLKLR

SEQ ID NO: 3591 - protein, 100 aa, synthetic construct
KLRYLRRLLKRYNKNRCRKALLLLRPFHAMKLQNVLRHYAELRSYAMFAQGALKQGAALEKPRPNSAKKRKFRATSLEAPHKSHPALPRRRLLRVIDYAQ

SEQ ID NO: 3592 - protein, 35 aa, synthetic construct
LIKLLRRLLKKFPKAEAIARAKSRQRNAWLRNHCD

SEQ ID NO: 3593 - protein, 22 aa, synthetic construct
RFRMFKKFWKLFRKTKPLALAA

SEQ ID NO: 3594 - protein, 40 aa, synthetic construct
YWKLMKKLIKLFRRIARRKTALNRTKCKTALSRGGKAQLY

SEQ ID NO: 3595 - protein, 61 aa, synthetic construct
LLKLMKRLLRRMKRSRRFLELQNQAAEANKWEWLLKKLCKWIKARVNARIIALMNIELSDA

SEQ ID NO: 3596 - protein, 27 aa, synthetic construct
RLKLFRKILKFFCHLRAWSQQYAKLAV

SEQ ID NO: 3597 - protein, 27 aa, synthetic construct
RLRFLRRYLRFLKRKNLTACRQFPLQS

SEQ ID NO: 3598 - protein, 72 aa, synthetic construct
RFKYIKRYLKLWRTTRTKMRKEQAVVLVVRKYAKLKLKYVLLRQAAWLTSKRKERLAILLYLARLQRVDFKA

SEQ ID NO: 3599 - protein, 60 aa, synthetic construct
WFRLFPKIFRRLKTCAIRLVQDRAHNYFDRNIKKALRAARILNRKRLATWTKLQKRPLAF

SEQ ID NO: 3600 - protein, 55 aa, synthetic construct
LFKFFNKYFRLMSKNARRRDGLWAWRLEQRALFAVLAARRKQLRSAIKALTHLRK

SEQ ID NO: 3601 - protein, 33 aa, synthetic construct
YLKLIRRFLKKMRNSQRRRARWARLLSNKAFAA

SEQ ID NO: 3602 - protein, 21 aa, synthetic construct
LYKWLTRFIRLLNRRWKAHMR

SEQ ID NO: 3603 - protein, 28 aa, synthetic construct
KFKIIKRLFRFLKQCAKLLKAQTATCLS

SEQ ID NO: 3604 - protein, 64 aa, synthetic construct
FIKFYKRLIKMFKRKERGLHCPNAALAKEAPHLCVPKKNYAAHLCKSRFARIKLRLLMARRANL

SEQ ID NO: 3605 - protein, 58 aa, synthetic construct
RLRYLKRFFRFLHKFLPVSKKELRLRVRQDFAACAILHKYLRCLANRARTPRELRRFA

SEQ ID NO: 3606 - protein, 35 aa, synthetic construct
RIRLFTKLLKKYKQFDFGATSIVKARRKLALAKLV

SEQ ID NO: 3607 - protein, 24 aa, synthetic construct
LMRWLKKLFRWFHRKYALKLVKRL

SEQ ID NO: 3608 - protein, 45 aa, synthetic construct
FLKLLHRFWKKMQQLKAKEKAFMNWCKHAADALAIKCRMDARLGK

SEQ ID NO: 3609 - protein, 59 aa, synthetic construct
LWRWLCKLFRRFKKLQIVCLARECKQCGGLLKAQKSTLMAKLREHRAGDLKLAKFLWKM

SEQ ID NO: 3610 - protein, 39 aa, synthetic construct
FWRLLKRFFKLFNRRLARIAQIQYLYHHLARPRLLLACR

SEQ ID NO: 3611 - protein, 20 aa, synthetic construct
LLRLMKKLFKFLTPRARYVC

SEQ ID NO: 3612 - protein, 70 aa, synthetic construct
KLRFLRRLLKKIRNALAVADTRGRHGAGSKAKRANRDLKLRPKLPTDWKDLMRNCARNRLALKCKGACNA

SEQ ID NO: 3613 - protein, 69 aa, synthetic construct
WMRLYRKMWRRLKCKGKPAAAGKFRATKGNARAARKCQLLHCMKLPDKAGCIRDKEYVKLRARLMARHT

SEQ ID NO: 3614 - protein, 34 aa, synthetic construct
KMRLFQRLIRLWHQRLKAWNLKRLLPAASKKISQ

SEQ ID NO: 3615 - protein, 95 aa, synthetic construct
KLRLYRKIYRRIHRRLRQRRMPLTRALLWFKMAIQRWHKLHNKSNDLNANKGLLADACKNRLLLIHVHKRRKTHFLLKLDAYLAASYAMCAADAF

SEQ ID NO: 3616 - protein, 30 aa, synthetic construct
RLRFFRKLLKLITRYERKADAAHEMAFKIK

SEQ ID NO: 3617 - protein, 45 aa, synthetic construct
RLKLIRKIYKLIKKKCFKSKLQLARLRLPRHLLLGALKEMLIRMR

SEQ ID NO: 3618 - protein, 61 aa, synthetic construct
FLRLLQKIIRLLCKINLAKLRQFKAFIVYYERRAEARRLNEMMKHRKLVAGALRCCFAPRK

SEQ ID NO: 3619 - protein, 24 aa, synthetic construct
RLRLMKKLMKLMRNHKHFVLRHLA

SEQ ID NO: 3620 - protein, 22 aa, synthetic construct
FLKLLRKMLKKYCNGSEKKLAS

SEQ ID NO: 3621 - protein, 47 aa, synthetic construct
KWRFMRRIYKKMRKALGKRRKLKAKAALCRLRAFMVCKAALALYEKS

SEQ ID NO: 3622 - protein, 85 aa, synthetic construct
IFKLLPKLMRRLNSPALHRAREAWLNAHDKARSDRRMFLKAYTWDFYRFPAAFALLYKRKAKRRNGVCLLHAFRARRAFTMKQYR

SEQ ID NO: 3623 - protein, 41 aa, synthetic construct
LLRYFKKMYKRWKTRKGQANPLLRGLAVWKARAIILIMRRG

SEQ ID NO: 3624 - protein, 43 aa, synthetic construct
RIRWLRRYLKFYPTRALALALNKKRRWGRLYDARFIARLAMLN

SEQ ID NO: 3625 - protein, 73 aa, synthetic construct
LLRLIQRLLRKWCRFNVANNFASKWRLMSAQRVLAADRNKKLHFWSLYKKRRRLLHLVVRLPGKHAARAKEVM

SEQ ID NO: 3626 - protein, 67 aa, synthetic construct
KLRIIKKILKRLTKASQKRLPALNDRRLQLKRLLLMGACSIRWDELLLNRREKSAHDYHLAHHEAAK

SEQ ID NO: 3627 - protein, 43 aa, synthetic construct
KLKLMKRYWKLLRRAAAAQKYNVGCLFNACILSRKQKRKEKWD

SEQ ID NO: 3628 - protein, 61 aa, synthetic construct
KYRMFRKMFKKFRNLAKTAKALRKRLWRGARGCQQLKYLNNAAKAEWKKGGYLAAEETVRL

SEQ ID NO: 3629 - protein, 53 aa, synthetic construct
YYKLLCKLMRRLKRYRVKLWRRQAKAARKDMARIRSAALAAALKILREKLIET

SEQ ID NO: 3630 - protein, 20 aa, synthetic construct
LLRMFHKIIKILHCRQRLAA

SEQ ID NO: 3631 - protein, 20 aa, synthetic construct
WFKIMTKLLKRLKPKHVAAQ

SEQ ID NO: 3632 - protein, 24 aa, synthetic construct
FWKYLKKILRKLTRAWRLYTCRLA

SEQ ID NO: 3633 - protein, 51 aa, synthetic construct
YFRWMKRLIKLLRRARHKRDKKHMSNKSAMFLRAHARLKCTYKRLIFMLQA

SEQ ID NO: 3634 - protein, 81 aa, synthetic construct
RWRILRRWMRKMHHSLKYHRLKAVAADKNGIAATKLTAGSRAHKKVTARWPRLKCRLNRKRLILLLALKAASLEAALADAT

SEQ ID NO: 3635 - protein, 33 aa, synthetic construct
RLRIMRKYYRKMPNQRLSAAAFRAAAMITWRLR

SEQ ID NO: 3636 - protein, 42 aa, synthetic construct
RMRLLNKYLRLWKKRQLDKLSRKVLLMEYKLLEIAYKIRAYA

SEQ ID NO: 3637 - protein, 52 aa, synthetic construct
KFRILCRWLKKLRHANFKAVCKRKAACHLLLAKYDLAAARRKRAKHKHLVNK

SEQ ID NO: 3638 - protein, 27 aa, synthetic construct
RFRWLCRFMKFFNSAAAQRFAAAAKLK

SEQ ID NO: 3639 - protein, 38 aa, synthetic construct
LWRIIRRFIKRFRHKKERSLPRPCSAKLLEVGAPKLAL

SEQ ID NO: 3640 - protein, 32 aa, synthetic construct
KWRLLKRLLRKFQSNRQKNLACGKMSCHGKLL

SEQ ID NO: 3641 - protein, 45 aa, synthetic construct
FLRMYRRFWRKLRRKLALSEKTQPLRIYESACKDADAHSWLAKAL

SEQ ID NO: 3642 - protein, 70 aa, synthetic construct
RYKLIKKLLRKIRPLTKRLLKRHMGWIALTARSALMAIDNRRPGALQLAYPKLKQMRARGPLDKWPKAYY

SEQ ID NO: 3643 - protein, 35 aa, synthetic construct
ILRLLKKWYKWLRKDEPYLALKRKDYRAVKKSAIL

SEQ ID NO: 3644 - protein, 59 aa, synthetic construct
KWRFIQRYFKLFHKLAQQWPRCLANLMTKLILLLMYKAYKALRLRKRDPPYRARAMKKE

SEQ ID NO: 3645 - protein, 34 aa, synthetic construct
KYRYWQKFFKYLKKPKPALAILKALKIRLQRDGF

SEQ ID NO: 3646 - protein, 21 aa, synthetic construct
YIKYLRKWIKMLSNLRKLLFR

SEQ ID NO: 3647 - protein, 27 aa, synthetic construct
MYKFYKKFLRLLRKLTIHAKDSRQKAL

SEQ ID NO: 3648 - protein, 36 aa, synthetic construct
RMRFWRRIYRRINPRAYNPKAALLLKAKLFDFRWTA

SEQ ID NO: 3649 - protein, 37 aa, synthetic construct
LIRFFKRWLRFFKRRDLWLALLIRGCMTKQLDADRKA

SEQ ID NO: 3650 - protein, 75 aa, synthetic construct
KFRWIKRMMKRLHKHLLSAAKALARMHDIAVAWTLKKQAKRFIKSALALEGHDKVAAAKTKLRYFMKKNKSPRCA

SEQ ID NO: 3651 - protein, 37 aa, synthetic construct
RLRIFRKIFKKIRNLCQRKHAMLLEKGANKCAFLELK

SEQ ID NO: 3652 - protein, 20 aa, synthetic construct
KLKLLSKFLRIYCPGLNKRK

SEQ ID NO: 3653 - protein, 69 aa, synthetic construct
WYKFMRRLIRRFKRRRQAKCWKIMIKATLVAAKRKMTFWRPLALRAKYARRNCLELLSFALPPESHLRK

SEQ ID NO: 3654 - protein, 22 aa, synthetic construct
KFRIIKKLWKFLRKQLLKAAFT

SEQ ID NO: 3655 - protein, 70 aa, synthetic construct
KFKMLRKLLRFWKSWKKKFWPAWLAISFKYAADKKKNCAATDYCRRGLVRRKLLHRLAGLKLARVRASQL

SEQ ID NO: 3656 - protein, 64 aa, synthetic construct
LYKYWRKLLKLFPKAWPRAAAQRSVKIRSRARLSGPKARLAMSLVLAKCNHKHKWNLIRLRKIK

SEQ ID NO: 3657 - protein, 80 aa, synthetic construct
LLRLLKKIWKYLSNNKMALWSAQPYAARTLQVLRVRPCKKAMCARSRMKEARICRHRLKRLFNRFTWALALPKRGLRDLR

SEQ ID NO: 3658 - protein, 53 aa, synthetic construct
KIKLMQRLIRKFKRKLDASLKWWRLERLANAAMFKRSKLHKMWAPLYLRKTQW

SEQ ID NO: 3659 - protein, 60 aa, synthetic construct
KFRWFPKWWRRMKCQNKARKLKLEREFMRLLGTERHSLDRLKRLAALEAKAVLTRDRHCN

SEQ ID NO: 3660 - protein, 57 aa, synthetic construct
FYKMLKRLFKFFNCAIPIIRMRSVRYLADAAALKGAALAANGRKAKKLELDYKKDAK

SEQ ID NO: 3661 - protein, 37 aa, synthetic construct
RFKMWTRFLRRWKRAALPKKLLWLFRYAGARLNANMR

SEQ ID NO: 3662 - protein, 40 aa, synthetic construct
RWRYLQRYFRLFKKFMQWANALKKKWQRKFLRKQLLLPFV

SEQ ID NO: 3663 - protein, 28 aa, synthetic construct
KWKLMRKMYKRIHPLWLAGKALHFRLAP

SEQ ID NO: 3664 - protein, 33 aa, synthetic construct
RLRYLNKWIRRIRRLLAMKRAALGKYATNRRLE

SEQ ID NO: 3665 - protein, 50 aa, synthetic construct
KFRYLKKLLKKIRPLRLRAAANKGTFFMARRSLAQSAHASKPHWALAWEL

SEQ ID NO: 3666 - protein, 55 aa, synthetic construct
LLRFLPRMWKWMRQAVRQAATKRMKLLARTAALARRDCPRRWKGERFESKRYAAI

SEQ ID NO: 3667 - protein, 28 aa, synthetic construct
LLRYFTRLLRKLQKKERSHICASQAAPK

SEQ ID NO: 3668 - protein, 40 aa, synthetic construct
RFRLLQKLMRLFRRKKAPPLKGGLNTKEAVLRIRNAELEC

SEQ ID NO: 3669 - protein, 45 aa, synthetic construct
LWRFIRKLFRILKPMRRLSARREKFLHNALYIFRSRGMAWYLRAK

SEQ ID NO: 3670 - protein, 63 aa, synthetic construct
RLKFLHKIWRKLQRHMRAQRAKHLRMPAKGHLKKGSLGNLRPARPLMAHLSKRRFHDYMKAPR

SEQ ID NO: 3671 - protein, 36 aa, synthetic construct
RYKFFQKILRLLNKIGEAAYANIYDRKAMRALRAKC

SEQ ID NO: 3672 - protein, 25 aa, synthetic construct
LWKLFRRWWRWLKTSKAAYLFKDRA

SEQ ID NO: 3673 - protein, 27 aa, synthetic construct
KLRLLHKYLKRFSTKERANEQNKARFL

SEQ ID NO: 3674 - protein, 25 aa, synthetic construct
WFRYFRRLLRKLKRNMRVAATALSF

SEQ ID NO: 3675 - protein, 55 aa, synthetic construct
LFKIMRRIMRKYRPRLKYVLEEAWLLWCKQEKHRWLGMLLALMFKRRRPRARRAQ

SEQ ID NO: 3676 - protein, 30 aa, synthetic construct
RYKMLSKILRKWTKLFAEAWRLRMFRELLA

SEQ ID NO: 3677 - protein, 23 aa, synthetic construct
KLKLMKKYFKLLCQQIARTYSAL

SEQ ID NO: 3678 - protein, 22 aa, synthetic construct
KLKFWCRLYKMYRRARPWLKAA

SEQ ID NO: 3679 - protein, 45 aa, synthetic construct
KLKILKRLLRKYSSAAWAQFRNANNAKQLKHDRSPALSYKCGRMR

SEQ ID NO: 3680 - protein, 30 aa, synthetic construct
KLRYIRRFLKLFRKIAAPVAKICNKARCMA

SEQ ID NO: 3681 - protein, 24 aa, synthetic construct
RIKLWRRFLRFLTKYLCKKLAALA

SEQ ID NO: 3682 - protein, 45 aa, synthetic construct
KFKLWRKLLKFWPTVDRLARHKHAFLERGKFFYSIDRRMLLRLLR

SEQ ID NO: 3683 - protein, 25 aa, synthetic construct
KLKFFHRLLRRLRCIADKFWATVLP

SEQ ID NO: 3684 - protein, 27 aa, synthetic construct
ILRYFRKLLRIFKKMPALSERHYLLEK

SEQ ID NO: 3685 - protein, 64 aa, synthetic construct
MLKWYNRLMRLMHRLRAKAHARKMVKRRAMHERKLKWKAKPDWASRADKFGLAACKKYTLIVKS

SEQ ID NO: 3686 - protein, 38 aa, synthetic construct
KIKLYTKFFKILRRMLFLLEKSTTKMAKKLAYANSLAR

SEQ ID NO: 3687 - protein, 29 aa, synthetic construct
LWRMLKRLFKKFKKMANAQALRSKLRHSF

SEQ ID NO: 3688 - protein, 22 aa, synthetic construct
RFRWLRKFFRRLNRLAMRRLAA

SEQ ID NO: 3689 - protein, 30 aa, synthetic construct
RFRILRKMYRILSKLLTKLTGDRLCGLIRK

SEQ ID NO: 3690 - protein, 27 aa, synthetic construct
ILRLFNRLFKLWKNRRARLDLLHSCQW

SEQ ID NO: 3691 - protein, 63 aa, synthetic construct
KIRWIPKLIKYLCKAQKDKRTGILKRAEGRSRHVCDALLQKRGMAKQAKLAALWWARAKPIEK

SEQ ID NO: 3692 - protein, 25 aa, synthetic construct
RIRLLRRFMRKLTRAVRLATTLRAN

SEQ ID NO: 3693 - protein, 42 aa, synthetic construct
YMKLYRRLIKRIQKERQLRLMHQGAKRNALSAKAQGALRKWE

SEQ ID NO: 3694 - protein, 34 aa, synthetic construct
KLKMLKKLLKYFTTLIYKRRTAAYNMAANHELLW

SEQ ID NO: 3695 - protein, 29 aa, synthetic construct
KLRILSRLIRRWTQKYRVAQALSAFAWFA

SEQ ID NO: 3696 - protein, 60 aa, synthetic construct
LFRWFKKMLRRWRRVLIARAPALSGRRYFRPMKKRHTQAMHKRLLQNKEKLAASANWDLR

SEQ ID NO: 3697 - protein, 36 aa, synthetic construct
FYKFLNKLLKLLRRKAKGYTGATQAWKASAWASILK

SEQ ID NO: 3698 - protein, 21 aa, synthetic construct
KLRLFNRFFRYLNRLARRLNK

SEQ ID NO: 3699 - protein, 28 aa, synthetic construct
KIKFLKKLFRFIKSFRLFYEARKMHAAA

SEQ ID NO: 3700 - protein, 30 aa, synthetic construct
FLRFMRRLIRRYKSARLALSTRYLAETHVK

SEQ ID NO: 3701 - protein, 30 aa, synthetic construct
ILKYFHKFIKKLKKWALALRKKFRAQLALQ

SEQ ID NO: 3702 - protein, 38 aa, synthetic construct
RLRFLPRLLKRMTKSWCPARRLTRTAHATELALALDRP

SEQ ID NO: 3703 - protein, 70 aa, synthetic construct
RIKLLRKLFKKFNTRLRLWLQCRKSLAKKLSWLRCAKVKRQARLFALPCVYDKESREEIMPLAMAVKYGK

SEQ ID NO: 3704 - protein, 75 aa, synthetic construct
KIRMYRKFLRKYRPYVIAARFYAALYILLSLRDLTALALRAMLTATKENRWRRALLFDYRIYFFLKPEAKLLRLR

SEQ ID NO: 3705 - protein, 61 aa, synthetic construct
YFKWLQKYYKKLCKRLLLAAKWLKDDHAALHGRRKLKRKWYWILHELAYLRMKRTILGARI

SEQ ID NO: 3706 - protein, 34 aa, synthetic construct
RLKLLKKILKKFRQCVLAIPDLRKQWFIRCATGK

SEQ ID NO: 3707 - protein, 21 aa, synthetic construct
LLRIINRLWRRLRQARTAWFP

SEQ ID NO: 3708 - protein, 38 aa, synthetic construct
LLRFWQKLIRRLKKSAEQKLCYNAWRCALLFTKEKSKN

SEQ ID NO: 3709 - protein, 78 aa, synthetic construct
FLRILRRILKFLNRAKWALRLMWHRSAAKTFRYPKNRRGNKLFQGLEMKAKWGAPRRKARMDAKDIRASRAAHCFLAV

SEQ ID NO: 3710 - protein, 21 aa, synthetic construct
FMRLFRRWMKFLSKLSARAVA

SEQ ID NO: 3711 - protein, 26 aa, synthetic construct
KMKILSKLLRRFSRIRRFNEAAAAWS

SEQ ID NO: 3712 - protein, 27 aa, synthetic construct
RLKWIRKMFKKLCRAADNRKGLYAIAM

SEQ ID NO: 3713 - protein, 23 aa, synthetic construct
YFRLLCKIWKKLQKAQKRYAILD

SEQ ID NO: 3714 - protein, 22 aa, synthetic construct
KLRLLKKFWKMLRKLYAKANQA

SEQ ID NO: 3715 - protein, 64 aa, synthetic construct
MWKLFRKILRRIKCAFATLRRRKSAMEAASAPRNLFQSAYHEPTARCAGPKLMRWALLRLIKRL

SEQ ID NO: 3716 - protein, 77 aa, synthetic construct
KYKLLRRIFKLWRRPKKWILRRMRWKLIAMHKGLLAKQLWLMMGENRYLASEGHAAILPASKKANLLRYENLRHLLQ

SEQ ID NO: 3717 - protein, 77 aa, synthetic construct
LLRLLTKMFRRLKHQAIKLLVLMNMECKTIGRVVKKKLKRKILCLMTAELRLFAGKEFKYKYPFAKALWRKEAGLRF

SEQ ID NO: 3718 - protein, 37 aa, synthetic construct
YLKFWRKIFRLWPKMLKKRKRLHALKAGWTLWSLYKA

SEQ ID NO: 3719 - protein, 23 aa, synthetic construct
RLKIFRRWWRWYRHRASAGLHLA

SEQ ID NO: 3720 - protein, 56 aa, synthetic construct
LMRIFRKFLRKLRKQKALKGLRRWLYAMEKFAFRQAMMGKMKRELLDYLTLHGYGK

SEQ ID NO: 3721 - protein, 32 aa, synthetic construct
ILKWWKKLIKWIKTLRKHLVRCHYADRKLADA

SEQ ID NO: 3722 - protein, 23 aa, synthetic construct
RMKFLNRLLRLIPKCLHAWLNRC

SEQ ID NO: 3723 - protein, 27 aa, synthetic construct
RLRLYNRYYRKIRTRRSAQLAAKQEIL

SEQ ID NO: 3724 - protein, 38 aa, synthetic construct
KWKYLRRFFRKFSPRSKLYGKRALKLKAPCDAKLALEC

SEQ ID NO: 3725 - protein, 46 aa, synthetic construct
KYRFLRKYWRRLHPLTKRLMFELQQRACLCAKKCLVANKALHRRQG

SEQ ID NO: 3726 - protein, 53 aa, synthetic construct
RLKLLRRLLRKLKTNPHWYLKKRWQYPHRKSFVFLATKSLRPRRKTAKALLAK

SEQ ID NO: 3727 - protein, 44 aa, synthetic construct
LWRLYPKLLRRMKRWAANHKAALWAYPKPCAELPMPVSRRDKAA

SEQ ID NO: 3728 - protein, 23 aa, synthetic construct
LFKLWTRFLRKFQRLAAHRCAFM

SEQ ID NO: 3729 - protein, 21 aa, synthetic construct
LLKLMRRILKRMNKGRISTAF

SEQ ID NO: 3730 - protein, 23 aa, synthetic construct
YLRIFKKMIKLYTKLANKQLKLD

SEQ ID NO: 3731 - protein, 44 aa, synthetic construct
FLKMLQKLLKRLRRERIIWVGASALLWRIDAFGRLAKHGTKRLL

SEQ ID NO: 3732 - protein, 56 aa, synthetic construct
LIRLLQKWMRKLKHRYKYAKELRLKKLPEAGWNKALWMTIALHRGKSITAKQDKEL

SEQ ID NO: 3733 - protein, 35 aa, synthetic construct
LWRLLKRLLRFMKCCRLDKAKALKRASQGRFKEKI

SEQ ID NO: 3734 - protein, 22 aa, synthetic construct
LFKFLCKYMKRLHKYKLTLKLF

SEQ ID NO: 3735 - protein, 57 aa, synthetic construct
KFRLLRRMLRLFRKAAGNIRDRYKNSLIPKNAKCRRESNEDCRCLLLAKLRYALFRA

SEQ ID NO: 3736 - protein, 23 aa, synthetic construct
KLKIWRRLLRWIRQAFWRALGAT

SEQ ID NO: 3737 - protein, 20 aa, synthetic construct
LMKFFKRFLRYIKRARAALM

SEQ ID NO: 3738 - protein, 36 aa, synthetic construct
YLRLLTKIYRRICRKRKRLAGKLKPLGAMMHLKALL

SEQ ID NO: 3739 - protein, 52 aa, synthetic construct
LLKLWHRLLRKFKKKLIRLDRRHAAARLDKLAKKKRDWWHLLAKRTKPIKKD

SEQ ID NO: 3740 - protein, 61 aa, synthetic construct
RLRYWKKFLKKLKRRALTRAKARRVREHNYFPAKKTLPKEYTLSTRNALLMMRKLLALGFN

SEQ ID NO: 3741 - protein, 58 aa, synthetic construct
FLKLWCRFIRRYRKLEENRALPLSTTKAKQSRYAKEKARPKDAKWAYFVKNKLATYAA

SEQ ID NO: 3742 - protein, 96 aa, synthetic construct
RFRFIKRMLKLLRKKRKLELMLKVDCKAKKSKCKRMAAAVHALGRPAERCAGTSLQLRKRKWAWRPAVLKAKRRKRKMADRLYHEPPLNARRLLNE

SEQ ID NO: 3743 - protein, 28 aa, synthetic construct
LMKFLHRLIRRLKKMRGGAQIAPLADAQ

SEQ ID NO: 3744 - protein, 69 aa, synthetic construct
KLRFLKKFLRWLKKSRLLAAELNANLSKDKMGAKLFKGRLGCKNRAKIKGYVRMNGKLAKKGQQYAKCE

SEQ ID NO: 3745 - protein, 57 aa, synthetic construct
RFRLLPKILRKFKQFRYKMRALRRRLCCKHLARRWALLVDKTALRGAWMFKIQLKVK

SEQ ID NO: 3746 - protein, 27 aa, synthetic construct
WLKLLNRMFKRLRRGLSLRALNRLPNI

SEQ ID NO: 3747 - protein, 58 aa, synthetic construct
RFKLLQRWFKRWKRLCAKARATPSAVARLITCAVISLALREVELRALRMRHKLCFRWL

SEQ ID NO: 3748 - protein, 34 aa, synthetic construct
YMKLLRRYLRRIKKAHALLPRMLKRHMALEARAI

SEQ ID NO: 3749 - protein, 25 aa, synthetic construct
RLKIMKRMLRRYQRLQRWAMQWLLF

SEQ ID NO: 3750 - protein, 30 aa, synthetic construct
KLKLLQKIWKLYRRHGKGAIAKMRKIVAYH

SEQ ID NO: 3751 - protein, 26 aa, synthetic construct
KWKIFKKFLRRLKKLFKLPCLNLTLL

SEQ ID NO: 3752 - protein, 54 aa, synthetic construct
RLRMWRRYLKKYKRQKHAWEIKRALRHKRLSVPLLRNARNALERTALLKYWHRY

SEQ ID NO: 3753 - protein, 45 aa, synthetic construct
FLRLLRKLYKWFNRILKMSLGRTIQAARRAAAKASYQSMLALRPK

SEQ ID NO: 3754 - protein, 20 aa, synthetic construct
LIRMIQRWLKKFRSAAAVAM

SEQ ID NO: 3755 - protein, 22 aa, synthetic construct
YIKLFCRLLKRLRKELLSTALW

SEQ ID NO: 3756 - protein, 29 aa, synthetic construct
MMKFLKRWLRKWTRALQRKAAQLHCRSML

SEQ ID NO: 3757 - protein, 64 aa, synthetic construct
KIRLLHRLYRKMCPPLCRKKKLREAKLRQKLARLSLQKSFLLILLTGYALACDACNSFYDKGDR

SEQ ID NO: 3758 - protein, 58 aa, synthetic construct
LLKFITKLLKKLNSLARRRIWPCRKYTTYGHQLNARAILRAEARDLVTDDKLKVRRAE

SEQ ID NO: 3759 - protein, 43 aa, synthetic construct
RFRLFKKLLKILRQETGLLLRRLVHFLANDAYKYFRVQVWLKL

SEQ ID NO: 3760 - protein, 36 aa, synthetic construct
RWKFFKRWLRRFKNAACVAVRTPLMMVKAKNRLLLK

SEQ ID NO: 3761 - protein, 69 aa, synthetic construct
KFKFFRKFMKLLNRKRRRCCFWSDFLKLLFLKMIGLRRAKNLLAYCLRKGWAARRLRRFDSYQNLKSWQ

SEQ ID NO: 3762 - protein, 37 aa, synthetic construct
LFKFLRRLLRKLCRHCIKKKRHRADWWKAAAWKNPHL

SEQ ID NO: 3763 - protein, 21 aa, synthetic construct
RIRLLHRWIKFLHQRGLKYLL

SEQ ID NO: 3764 - protein, 24 aa, synthetic construct
LYRFMHRLIRRFPKKTKANCLLAL

SEQ ID NO: 3765 - protein, 32 aa, synthetic construct
KLKLLSRLLKFFKRARRKALRLTPKPRPGDIL

SEQ ID NO: 3766 - protein, 46 aa, synthetic construct
KLKLFRRFLRFLKRWRAQRFCLRKAGWNRPLKIAPSYKSLKAKHNA

SEQ ID NO: 3767 - protein, 21 aa, synthetic construct
IIRWLKKYFKKLKRTAALVLR

SEQ ID NO: 3768 - protein, 61 aa, synthetic construct
MWRYLKRWLRKIKQASKKACVATWKDYYFRLLDGIARKRKFSVKLALGSAAVPRLLKKKVL

SEQ ID NO: 3769 - protein, 60 aa, synthetic construct
FIRLMRRFYRKLHRKEMQLVPNARLYRRFLKKHRLKTGAHAAMKSLCAVMEWKARLDKAL

SEQ ID NO: 3770 - protein, 80 aa, synthetic construct
RLRLIKRLLKFFQPAIYARILKPYMFWRRCWFLSLATKAALFNGNKSLKANDLKKWKRYLKKAVCLAHKLQKAYAIEAWA

SEQ ID NO: 3771 - protein, 32 aa, synthetic construct
FMRLFKRLLRFWRRNLTAILCKMALRPRSLHL

SEQ ID NO: 3772 - protein, 47 aa, synthetic construct
KWRMMQRYLKKYKKAWLLQGNLADRKLAVALPQKAKNADRWDCGRVR

SEQ ID NO: 3773 - protein, 97 aa, synthetic construct
MIKYFRRLLKKIRKHKTKRVLELRHALMTHENKLTFLYMHLKKQQVTYHQAFIKRKAAPPKLKLKLGAKKPIPKKLARLRTRALRNPKLRLPWGHSA

SEQ ID NO: 3774 - protein, 21 aa, synthetic construct
WLRLIKRIFRFLRRRDLLYAD

SEQ ID NO: 3775 - protein, 75 aa, synthetic construct
RLRYWRRLLRMLCSLWKLRLSTVVMALKRERRKVANRLLSEALERLCKYEDKRQAKHLSKLPMHKAQKMLKRQNL

SEQ ID NO: 3776 - protein, 45 aa, synthetic construct
LLKLFKRLMRFFRKKASNRWKCWTNRQAFGWLMRYKLHALLKTRY

SEQ ID NO: 3777 - protein, 36 aa, synthetic construct
IYRYLKRILKYFKCNAHPRTIRKALMSLSRAAAYAA

SEQ ID NO: 3778 - protein, 23 aa, synthetic construct
KIRLFKKYLRFLQRDANVVLARD

SEQ ID NO: 3779 - protein, 26 aa, synthetic construct
KFKFIRRMFKLMKNRLYLPAKATLAA

SEQ ID NO: 3780 - protein, 52 aa, synthetic construct
KFRLFRKIMKRMRRLARTKPHLAALKMEDRLAVRVRKMQKCYLLLQDRMPIV

SEQ ID NO: 3781 - protein, 77 aa, synthetic construct
LYKFFNRWWRILKSKLRMTRRQACAVALIMTAWEQLIHKKAAFKLRPKVDLAYMAYAWAAFARLNRKMASRLNRRAR

SEQ ID NO: 3782 - protein, 29 aa, synthetic construct
LWKLWKRLYRLLQSNCCPNKRVLYRKLKA

SEQ ID NO: 3783 - protein, 52 aa, synthetic construct
MIRLFKKLLKMYKNKEAAAKDRYKRASRAEGASALHAMLCCKLRKQALKWRA

SEQ ID NO: 3784 - protein, 32 aa, synthetic construct
LLKFFRKFLKRFKPDRRTQRKFHLDIFLSLLL

SEQ ID NO: 3785 - protein, 73 aa, synthetic construct
RIRLLKRFLRRLNRYALVDAVDLMAEKAKAALTLKAMDLKRFPAVLSPFAYSRQLKFKSSIKMINKAAKEISL

SEQ ID NO: 3786 - protein, 77 aa, synthetic construct
KLKYLRKFLKRMSHKRRFGKMAGGGQALDAMKAGKAVLVKSACIRALWDKCASRKGAACLKAFRKKRLQREIIKILH

SEQ ID NO: 3787 - protein, 49 aa, synthetic construct
WIKILKRFLRKMNKLPRLCKTGKMKKALLKYNCAYLKSQLGLASYRAAI

SEQ ID NO: 3788 - protein, 95 aa, synthetic construct
LFKFFRRMMRKYQRRTKSAACQATLKKRVYKKRLLKLGTTNAQEHKWALSHRAALMSAPHTNWARKFACKKKGLLKMKRAEATLRARWMDFQLKK

SEQ ID NO: 3789 - protein, 61 aa, synthetic construct
RWRWYKRIWRWLKKRVRRMLLAASSQAAIFLLYALVYPRRRKNLCLWLAKSRKDMLRKKRY

SEQ ID NO: 3790 - protein, 83 aa, synthetic construct
RIRYWKKFMRKMNKSALQQRARILDACCRLKPETAEDRALIRQWATYPLWRYLSARRLRKLCKNLRARDARKKTLIRTKNLNT

SEQ ID NO: 3791 - protein, 55 aa, synthetic construct
KMRLIQKWLKRLCRWWLVILKRLTLQRAAAKLLKIADCYLAVKLSSKDYRDGKLI

SEQ ID NO: 3792 - protein, 39 aa, synthetic construct
ILKLWRKMIKRLRKRRKQRAFLKLRALLELRANMAVSHG

SEQ ID NO: 3793 - protein, 27 aa, synthetic construct
LLRFLKKIFKFLPTANIDRFIKKMALR

SEQ ID NO: 3794 - protein, 40 aa, synthetic construct
RFKLFHRLLKRLPREQRGRVKHRNRLTSSQHLANRAYYLK

SEQ ID NO: 3795 - protein, 36 aa, synthetic construct
LFKWFRRLLKFIKRLAADNRAGYQKVARSTKKVRCA

SEQ ID NO: 3796 - protein, 47 aa, synthetic construct
RLKIIRRMLKRLRPKLWKGKVRMSRMWIKLGAVLLLPKEAEWLLLAH

SEQ ID NO: 3797 - protein, 37 aa, synthetic construct
LMRWIKRLLKFLRKKRKSMGLRAYVEKALQQKGLVLQ

SEQ ID NO: 3798 - protein, 84 aa, synthetic construct
LLRWLRKLYRWIKTSLRKRRTRSSYRELATVGECALFAARVKAAILDRIRRSDIAVEIQASAFCEYNRAAPKWLCLARLKKLAL

SEQ ID NO: 3799 - protein, 34 aa, synthetic construct
RYRWLRRFFRKLPPGLKRGLDEAAARIKANQRHT

SEQ ID NO: 3800 - protein, 93 aa, synthetic construct
IIRLLRKFWKRMKTDARALRASLYHNRNDLQLRAALLAFLATRKRERKLGNATPRVLLHPRGNCRLLMSQFKSANCLKRALKIQMPLRREVAK

SEQ ID NO: 3801 - protein, 61 aa, synthetic construct
KLRLIKKLFKRFQKGKVALMKWATWATAAFRMYCHLLNTARWRWKTLARWEKLIPIKYRRR

SEQ ID NO: 3802 - protein, 70 aa, synthetic construct
KYKFIPRFWRYWKKVPGARNELKYKKFMLAKVRKKLRKRPLLAIMRTARAASRWPFNADLLNAKPWRARP

SEQ ID NO: 3803 - protein, 73 aa, synthetic construct
RIKYMRRWLKFMHRKYAKVNGKLKKEFDRQWCRKALNAFAYLKRPVLEFELRPWRRQAMLARKKAYAQRARLA

SEQ ID NO: 3804 - protein, 26 aa, synthetic construct
RYRLFHRLLKIYKRLMLWASAIKALR

SEQ ID NO: 3805 - protein, 40 aa, synthetic construct
KIRILPKLWRFLPKRLANQRKRWNALWRMLNLYQALNYLQ

SEQ ID NO: 3806 - protein, 35 aa, synthetic construct
KLRMFTRFLRLYHKWARKVYKNADLDGADRRAKLR

SEQ ID NO: 3807 - protein, 43 aa, synthetic construct
LLKLLRKLMKKFQRKEQHEARAVGWLLAKYLTRREFRPRPWKW

SEQ ID NO: 3808 - protein, 21 aa, synthetic construct
RLRYMRRWWRLLRHLVDLWPA

SEQ ID NO: 3809 - protein, 29 aa, synthetic construct
KWKLWPKLYKMLRRLHAKEKLLFLGRCLM

SEQ ID NO: 3810 - protein, 40 aa, synthetic construct
MWRLFKKLFKYFRTGLARLAALLKLDCALELCTDHIKIYK

SEQ ID NO: 3811 - protein, 22 aa, synthetic construct
RLKWYPRLLRLLNNKARYDQAI

SEQ ID NO: 3812 - protein, 91 aa, synthetic construct
KFRYYSKFWKRIRTKWEKSKETLCYRRAKRFHRNYAAKQRKLAEPVLRVLALLQRKLRKLILYLLDRRRKLLSARKIRRQLAEDQKQWAWL

SEQ ID NO: 3813 - protein, 82 aa, synthetic construct
MLRFICRFIKRMRPVKLLFTPCLRAVEAAANRNLALRAKFRRLARQVAANLFRGRLRDWYNKLGRYLVLASKLIQRPSLLML

SEQ ID NO: 3814 - protein, 60 aa, synthetic construct
RLKLMSKWIKRLRKLPWCRGYARLKLFVQYLAFKEWRRHYYARRFAAAGTAKWTLLLFKS

SEQ ID NO: 3815 - protein, 95 aa, synthetic construct
RIKLLRRILKFINRRQHKARRAKTDKDRACVKWAVAKKYLAQAARCARQKAAEMLCLGLLACTYKWVARLFVDDKALLWYYHILVGASLRRKILK

SEQ ID NO: 3816 - protein, 45 aa, synthetic construct
YFRIMQKYLKKFKCYRRARTMKKHAKLKTFGLKAALYCSKTLRLA

SEQ ID NO: 3817 - protein, 28 aa, synthetic construct
RLRLFTRLLRKMQRYCKADLKLAARDCQ

SEQ ID NO: 3818 - protein, 21 aa, synthetic construct
KLKLISKWLKRWKRALQYLYC

SEQ ID NO: 3819 - protein, 20 aa, synthetic construct
RLKFFNKLLRKIRKLWAAVV

SEQ ID NO: 3820 - protein, 24 aa, synthetic construct
LFRLWKRWLRKLKKVRLYALHASK

SEQ ID NO: 3821 - protein, 45 aa, synthetic construct
MLRLIRRLWKIFCRRKKFFTTLRLAPMRAKEMTLLAFLKAEQLMK

SEQ ID NO: 3822 - protein, 24 aa, synthetic construct
LFRLWRKLIRMLKPKALQKTTHKI

SEQ ID NO: 3823 - protein, 38 aa, synthetic construct
MYRLFTKWLKRYNPEKLVYKKKHLPALGMAELLLAGRL

SEQ ID NO: 3824 - protein, 56 aa, synthetic construct
WLRLMTKLFRKYKKHRPKLLLRTLKQWLAAHIKLKAHYLFEARKKTYKLAKATRKH

SEQ ID NO: 3825 - protein, 95 aa, synthetic construct
RLRMLSRMIRYLKRKALPYQMLRYRIRKRLELWGCFRAMGWNAKRVCKRLWKLALRMKNHKFAKYMKRPQLTAIRPSATPFNKRKLTLAAKAIKI

SEQ ID NO: 3826 - protein, 78 aa, synthetic construct
RYRFYKRLFRKFKCLRCLDHVDYCYAMIAKKALLTRRLAYARSTRCALAIVKKRLLQMRRDSLRNKATDDMECKLKAE

SEQ ID NO: 3827 - protein, 22 aa, synthetic construct
FLKYLKKLLRKFSNALAAKSRK

SEQ ID NO: 3828 - protein, 36 aa, synthetic construct
YFRWFCKFIRRYQRAEVKNRAKLLLYLQLARVLRTL

SEQ ID NO: 3829 - protein, 40 aa, synthetic construct
YWRLFTKLFRRLKHAAPAKKKRRAMRLKIFCRLERLDDAT

SEQ ID NO: 3830 - protein, 93 aa, synthetic construct
KLKLYRRWYKRMKKALKPAHVAIEARRKWRLSKRRLRYDYNAASAAYMKARSAEAALPKKSTAEKCALWKMERLWPLFLRRLLTAYNKLGNDK

SEQ ID NO: 3831 - protein, 47 aa, synthetic construct
IFKFMKRIYKRFPRALALLMGARRKWMNWNAALIRAGLLKKKWCWKR

SEQ ID NO: 3832 - protein, 37 aa, synthetic construct
RLRLMPRLLKFLRKAEAFPKLKIKERLKCGPPTGAFK

SEQ ID NO: 3833 - protein, 56 aa, synthetic construct
RLRLWKKLLRKISKRLHKIKWDSALPGAGKAWLRRRWKLKAYNLFRKKAAKHQKSL

SEQ ID NO: 3834 - protein, 37 aa, synthetic construct
RLKMWRRLLRKLRQAKAAAAAQKKLANRRALQILSLK

SEQ ID NO: 3835 - protein, 24 aa, synthetic construct
KIKFLQRWLRMYPRLALRYLRHAN

SEQ ID NO: 3836 - protein, 77 aa, synthetic construct
RIRLWQKLMRKLKRAKPRNIRFIHHAAHAHCARNQQALTRNHKTLAIRLHRRKRYARRYAYYKLRRRATMKWALWKP

SEQ ID NO: 3837 - protein, 74 aa, synthetic construct
KFRMFKKFFRRLCHKRRALALSCQKKRLLKHAYQCICFWERWNALAELQPTAKLNLLRLRKRIALSVENLRPLR

SEQ ID NO: 3838 - protein, 35 aa, synthetic construct
RLRMIKRLLKKFKNLVEIVQIDLARLWQVKRAAAW

SEQ ID NO: 3839 - protein, 20 aa, synthetic construct
KIRFFRRYLRLLRNILFTAR

SEQ ID NO: 3840 - protein, 56 aa, synthetic construct
KLRLLKRFIKKLKHRAAERSGFCIRARAQYRHKKLCRHPFVRDCVLIKLAIALTMC

SEQ ID NO: 3841 - protein, 67 aa, synthetic construct
KMRLLRKFMRRIKRIFLRLRHKCQLALFDTANLLPRRQVQAAAMGTYKRLRACSAKQLRLCFYCKRK

SEQ ID NO: 3842 - protein, 69 aa, synthetic construct
RLRIFCKLMRLWKRYVYDLARVRWRKYCLYRRRKCNRPETASYNALLLKQKKLKAQLPSCLLSLKLCAD

SEQ ID NO: 3843 - protein, 24 aa, synthetic construct
YWKFLKRFYKLMPRRAAANQKKTL

SEQ ID NO: 3844 - protein, 72 aa, synthetic construct
KWRFIRRLIKLLCCKKWRLQPILLLQGVKATKYKRPLELFKPSRALLRCRACAFLDEITRAVALGARCRKKF

SEQ ID NO: 3845 - protein, 54 aa, synthetic construct
LWRLLQKWWKMFRNLRFLNVASRRRAFPQRKFFKLNRALLFAAANAVCWRARLY

SEQ ID NO: 3846 - protein, 30 aa, synthetic construct
RFKLMKRIMKKLQRLYKNARKAYADMKAIL

SEQ ID NO: 3847 - protein, 32 aa, synthetic construct
RFKFLNRYLKKMQPCLLGFNALKLKDAYADLR

SEQ ID NO: 3848 - protein, 23 aa, synthetic construct
KLKYLPRWLRLMKRTLAVWCKGR

SEQ ID NO: 3849 - protein, 33 aa, synthetic construct
MLKLICRLFKRLKSATDAGFLAAARLYGRKTPR

SEQ ID NO: 3850 - protein, 52 aa, synthetic construct
YLKIIRKLMRRFQKKLRRKRAHAKLQVAAIAPHAKWKLLHQAERAMKKCTAW

SEQ ID NO: 3851 - protein, 37 aa, synthetic construct
RMKLLRKFIRKLRKRRLIAQEGRALARKLDLAAMLYL

SEQ ID NO: 3852 - protein, 25 aa, synthetic construct
FIRWLRRFLRLLRNCAYLHLTGAQR

SEQ ID NO: 3853 - protein, 91 aa, synthetic construct
LMRLLKRYLKILTRRHGHNQLIKASRLWALANTIKACAITFRCLEWLKLIYEGALRALRQERRKARKRLKDYLGARGVFLACLGSLDRACW

SEQ ID NO: 3854 - protein, 31 aa, synthetic construct
MIRMFNRLYKKLRKKLAVLRARKMAKCFEAQ

SEQ ID NO: 3855 - protein, 60 aa, synthetic construct
RIRFLTKLFRRFRQKFLLWMLNKKKVIAKYKKAETHLEDAASIVKKTVLRLLSKLGLASW

SEQ ID NO: 3856 - protein, 37 aa, synthetic construct
RLRLIPRFIRKLHNREHITFRRCAKDAYRNAKLATRA

SEQ ID NO: 3857 - protein, 47 aa, synthetic construct
KLKWLRRWYRKFTHLATACKVLKGHTFRRDFALAPLKWKALKRGMLV

SEQ ID NO: 3858 - protein, 22 aa, synthetic construct
KLRLWKKFLRLFNHKLIAKLRP

SEQ ID NO: 3859 - protein, 47 aa, synthetic construct
ILRLMHKLLRMLTRFRFRAMQATKRRRKAQDCCKYAALGLNLWMLGL

SEQ ID NO: 3860 - protein, 70 aa, synthetic construct
LWRMLKRILKLFRKAVALVWKGLRKALDLMKRKRSRPSAPRLFHENKLWLLRAHCAAWWFFRRYKKDVTG

SEQ ID NO: 3861 - protein, 25 aa, synthetic construct
WLKWFCRFLRKMHRFAANFARAKLF

SEQ ID NO: 3862 - protein, 42 aa, synthetic construct
MYRIMKKLMRMIKHLYGAKRLLAMKILLRFWRLPMYHRRARR

SEQ ID NO: 3863 - protein, 80 aa, synthetic construct
KMRMLKRIWRKLRQFYAMGEGNDRCSKDGALLLDALLRATWKWVLSEKNAERASCRHRFNLALPKKRKKALLRIARNDRR

SEQ ID NO: 3864 - protein, 21 aa, synthetic construct
LWKMYHKFLRILKKASVSKKA

SEQ ID NO: 3865 - protein, 49 aa, synthetic construct
WLKLLSKWYRRLRRQRRHLFLRAAHDLVSGCDARLARDRDQSHVLMARA

SEQ ID NO: 3866 - protein, 94 aa, synthetic construct
KLKMWHRFIKFLKKKADKLMPWMKKFKKAISAHEAWYYADLRLKKAHGKMIALALKCEQLEQLALDMYCDAATAKLANPKFRAARCLIILERLK

SEQ ID NO: 3867 - protein, 33 aa, synthetic construct
RFRWLRRIWKLFKRALWFPKQKAKPKHRLLATA

SEQ ID NO: 3868 - protein, 24 aa, synthetic construct
RFRLFTRWLKLFKPAAHLSLRAHM

SEQ ID NO: 3869 - protein, 42 aa, synthetic construct
KLRMWRKMFKKFRNAMLKGLQKWMAKIFLKQKYRGLQAHLLR

SEQ ID NO: 3870 - protein, 43 aa, synthetic construct
RWRLFKKFLKLLHKKTALILPRLAWFKECLMKAKWLRRKVRGT

SEQ ID NO: 3871 - protein, 41 aa, synthetic construct
KYKWLHKYIRKFKKWRAHAKAPLRAELAGLRCGLKRIKCAT

SEQ ID NO: 3872 - protein, 28 aa, synthetic construct
RMRMLRRFFRLLQRNDYKMAGRLRATYL

SEQ ID NO: 3873 - protein, 85 aa, synthetic construct
KIRFITKWLRRFSRGRHRLKRISDFARANRKKILSAFLKRRKCLRYKFQNLTWADARPRPLVAGLRPDLLRRLRLERFHPARPAL

SEQ ID NO: 3874 - protein, 57 aa, synthetic construct
YLRLLKRLMRKLRQQRRAKHLENFHAHRLWAAARLRFLLKHGRATQNLMPNAAYGGQ

SEQ ID NO: 3875 - protein, 38 aa, synthetic construct
RLKMMRKLLRRMHKARPPHHAKAWWAQLKWIRILPCLL

SEQ ID NO: 3876 - protein, 40 aa, synthetic construct
KWRWIKKIYKRIHSKWPPALLHAAIACNLGKRKAWNAKKK

SEQ ID NO: 3877 - protein, 38 aa, synthetic construct
KMRLWQRLIKKWKTLAANHVLYKKLWVADRLRACYNAY

SEQ ID NO: 3878 - protein, 46 aa, synthetic construct
MLKLFRKLMRFFSKTDLGKMKARARTKHLLLTKTSRALGVLAYMHL

SEQ ID NO: 3879 - protein, 25 aa, synthetic construct
KLRLIKRWLRLIPKVKADWIMMQRA

SEQ ID NO: 3880 - protein, 31 aa, synthetic construct
FLRILPRMMRKLRRVRRKAYEARLNALMFIF

SEQ ID NO: 3881 - protein, 34 aa, synthetic construct
LYRLFKRLWKKFRRLALASILKPMPCLRAKNASS

SEQ ID NO: 3882 - protein, 91 aa, synthetic construct
RMRFLRRMFKKYCQRRRLHNKRPWFKKVSERSAKPCLAWPMKAILHLKRKDLLLSLGRIGERLLATWALWRPEDKKKDKLKTKDLRDLRTA

SEQ ID NO: 3883 - protein, 34 aa, synthetic construct
RLKYYKRFMKLYPSFIQTNRWLKKALRYKLLAKW

SEQ ID NO: 3884 - protein, 87 aa, synthetic construct
LFKFLRRYYRRLRNYLMQAKLRDKCVKTLKRRCPSIQKCDGRAVRKLLLAAWVMLYFKALVSNLAYRKHLRHARLSLFVGNLHYALK

SEQ ID NO: 3885 - protein, 45 aa, synthetic construct
RLRLFRRLWRMLQRADWPAPGARDLFKRQWHAAMSLKPAKLLKML

SEQ ID NO: 3886 - protein, 37 aa, synthetic construct
RLRIYRRLMRRLRSVAELRTRLNLDAIKRKSMAYQIP

SEQ ID NO: 3887 - protein, 56 aa, synthetic construct
FIRLWPKLLKKLRKLLSRKLKRLAAQAKYKKCNMTKNNLMPFADWHPRQIREHAFL

SEQ ID NO: 3888 - protein, 78 aa, synthetic construct
KYRFWRKFLKLLPKLRRSEAWKALRRCKMLDRGRLITKCKAKAVEAAYIYCDKRACTVHPALPHDLVLMRLLTLVKWR

SEQ ID NO: 3889 - protein, 30 aa, synthetic construct
LWRFLRKMYRKLPQLCAAKRYKRRFDLKSA

SEQ ID NO: 3890 - protein, 29 aa, synthetic construct
KIKIYRRMFRYLQPAILKRAHLFNRAQAA

SEQ ID NO: 3891 - protein, 83 aa, synthetic construct
RIRLMRKMIRRWRTAHCLSDMLQRARMAADAIAIHKHKQRQGQERLVRQAKLRCWHAKREKKAAPLEARKATGFYMRRALAGA

SEQ ID NO: 3892 - protein, 43 aa, synthetic construct
KLKFIKRLFKRMKCLLLFRRIFVCLKAGQWLRMRAHYCKEFKA

SEQ ID NO: 3893 - protein, 26 aa, synthetic construct
LLKFLSKFFRLIKKKKARKLANAWAN

SEQ ID NO: 3894 - protein, 32 aa, synthetic construct
KWRFLTKFLKLLRNVKKRQTLLIKALLLRQRT

SEQ ID NO: 3895 - protein, 46 aa, synthetic construct
MIRIWKRWLRLLKKRNRFKGSMAMAFRIDLKPLGLEAFKRLAKSRY

SEQ ID NO: 3896 - protein, 91 aa, synthetic construct
MWKYFNRMMKLLRKAEAILAVKKKTIRQRSQLRKLLIKRPTLSARRRHKKMLRSMNKRMWIIKLLGPKAWKLRYGPVTVLLAAKKACANRK

SEQ ID NO: 3897 - protein, 47 aa, synthetic construct
RLRIYQKFIRRYHRPCCLPWQAATRLQKRDKYLTEAIKRLLKLALKG

SEQ ID NO: 3898 - protein, 22 aa, synthetic construct
FIRLLRKFLKRLRPIARAPHPG

SEQ ID NO: 3899 - protein, 42 aa, synthetic construct
LWRFLCKWLKMMHKQRCRKVLDWKKCLARAMNRRAAFRARLL

SEQ ID NO: 3900 - protein, 81 aa, synthetic construct
KWRLLRRLLRRWKRAVEKKERANNAIAIHFAAYAWRGRRMAYKYVRQVPVNLTLPKLAARLAAKLKRRQSCWKWELHIRAR

SEQ ID NO: 3901 - protein, 43 aa, synthetic construct
KMRFFKRIYKFLKKPSFETDRVILRLRLRLAAKDLAAAARLNH

SEQ ID NO: 3902 - protein, 58 aa, synthetic construct
KFRMLKKMWKKIKTSMCERGLNCAPRLCAYIHRKQANRYRPALRAMARASKALALDML

SEQ ID NO: 3903 - protein, 21 aa, synthetic construct
LLKFLKKLLRKIKKCAFRLAS

SEQ ID NO: 3904 - protein, 32 aa, synthetic construct
KFRILKRLLKRLKREMGPCWALRSHWVNALRN

SEQ ID NO: 3905 - protein, 81 aa, synthetic construct
LLKWLKRFFKLFCRALARTLAMCWRWDFNFARLQHYQEARRTFVASKRIHYAKGLRRKRWKDIWAKLLREYKKLRIALKLK

SEQ ID NO: 3906 - protein, 87 aa, synthetic construct
FFKYFKKLYRKIQKRRGRWKYLKRVAKLKRALQLLKVKRQYHVYDLVAQRRIAAKVLYVRSLLLKRDLFITCSGPLRIERQDKVLKA

SEQ ID NO: 3907 - protein, 44 aa, synthetic construct
LLKLYPKLLKKYRKQHRRLIELKLALAIRSAAKLRWAFCCHICC

SEQ ID NO: 3908 - protein, 20 aa, synthetic construct
RYRLLHRFWRKWRTLNAPVL

SEQ ID NO: 3909 - protein, 48 aa, synthetic construct
IFKMLKKMLRLMPRLLRLPHARMAGWTTMKCRKCQGKRRRLLYKCALF

SEQ ID NO: 3910 - protein, 24 aa, synthetic construct
KIKMWKKLLRRYHTAFSVLALRSL

SEQ ID NO: 3911 - protein, 22 aa, synthetic construct
KFKLFRKMLKLLPKFAEKSKAA

SEQ ID NO: 3912 - protein, 72 aa, synthetic construct
IWKFFKRFFKRLHNKYAKTNRLKLALGFPARLELKKLKALARGDHRMKHRAARPMKKFARRKAALDLCKMLR

SEQ ID NO: 3913 - protein, 60 aa, synthetic construct
RLKFMTKLYRKLKKKQNFRAGWKCFKILLKDWQRAAIHLRGLRMSKRQRLSLRVLHRVTL

SEQ ID NO: 3914 - protein, 75 aa, synthetic construct
FYRWLKKMLKIWRCHACLSARMNEKLLAQYDLKKKTTAKRVKKARKKHLSKLPARKQKAPPHMSLRYLAKCIHLR

SEQ ID NO: 3915 - protein, 41 aa, synthetic construct
LWRLLRKWFRRLRPKKWRHNLMYALRACHMKGCREYLKARL

SEQ ID NO: 3916 - protein, 66 aa, synthetic construct
RLKFMHRILKKLRSIQKLGPNACLELWLWIAALAARLRSNDKQRSLRRSPAMLERRAKHFKKRDLL

SEQ ID NO: 3917 - protein, 54 aa, synthetic construct
KLKFLHKLLRRYKTQPAMKRDLCLTRRNHKANKNDAALEVAATCQVRLRLLILF

SEQ ID NO: 3918 - protein, 24 aa, synthetic construct
RLRLMCRLWKLYRTLFARQMRNKL

SEQ ID NO: 3919 - protein, 36 aa, synthetic construct
LLRLWRRIWRIIRKEALVRCAEPKLPLFLWAGLRTK

SEQ ID NO: 3920 - protein, 44 aa, synthetic construct
WLRILRRFMKWLKRWAANRIVLEHIKRFRQLLAARAMWQRLVKE

SEQ ID NO: 3921 - protein, 20 aa, synthetic construct
LFKLLKKFMKRMKNKWLAAL

SEQ ID NO: 3922 - protein, 34 aa, synthetic construct
LLKYWNRLWRLLQKALCLDGLKRLRADRMLRCRS

SEQ ID NO: 3923 - protein, 85 aa, synthetic construct
KYKFLSKYFKKWKQKLKADTATFMNRRVWERLKDTERLFAWYNEHARTKAALRDGAAAKKRACAKLLDKAVKREMANAVAMTAKI

SEQ ID NO: 3924 - protein, 43 aa, synthetic construct
RLRWFKKLLKRFHKLLLLNAAYKAKLAYRDLNRAGRMANTSQV

SEQ ID NO: 3925 - protein, 53 aa, synthetic construct
RLKLIRRMFKKYQRKWRGLRRLRTALPVLLRATVFRLKQLAPLKLPKAFRNKD

SEQ ID NO: 3926 - protein, 49 aa, synthetic construct
MIKIYRRLLRKLRNLKDIKRNGTRSECASLRAAFLKRLGTFELLVPQRR

SEQ ID NO: 3927 - protein, 32 aa, synthetic construct
RIKFLTKLYRLLNHVAKLGLKLMARRPNIRLV

SEQ ID NO: 3928 - protein, 23 aa, synthetic construct
LYRMLKRYLKRLRRLWRTFAILY

SEQ ID NO: 3929 - protein, 44 aa, synthetic construct
LLRLFKKFYKMMKNKNPLMLCLFRAKLFKLRRLVKNKLITMKSG

SEQ ID NO: 3930 - protein, 43 aa, synthetic construct
RIRLIKKFLRKLRPCKGNTAACKSVVKRLPDAAELLFGLKWEA

SEQ ID NO: 3931 - protein, 41 aa, synthetic construct
RFKWLPKWFKLLKHAYLLPLTKWLYAKLRTLILYRRWKYKG

SEQ ID NO: 3932 - protein, 33 aa, synthetic construct
RLKFLNRYMKRYNRCYAGLLAMAAWRIRRPRDK

SEQ ID NO: 3933 - protein, 59 aa, synthetic construct
LWRWMSRFFRKMRKFHRPDAATNDARHYAAASQLKAYLDKQALRKPCRYCRKKIAAAAA

SEQ ID NO: 3934 - protein, 40 aa, synthetic construct
YWRWLHKYIKLLKSRIRCLIYIILAAAKHGRRKKLGANMA

SEQ ID NO: 3935 - protein, 50 aa, synthetic construct
KFKIFNKLIKLMRRLAPRLFLIWRMKAGPGNNRVAALLFKKHRRQLEARF

SEQ ID NO: 3936 - protein, 62 aa, synthetic construct
LFKLFSKMLRKYKKKVKAKQLFDRIARRFSLELLYFCLAYKWHLALRVAYRKKCLMDTLSHK

SEQ ID NO: 3937 - protein, 55 aa, synthetic construct
KLRFFKKYLKLIRQFKQIKSANMKMCRKRAHCRLYNAADVLAAAGRAKKAAEKRK

SEQ ID NO: 3938 - protein, 50 aa, synthetic construct
RWRWMKKMIRWLKRLKAARKIMLCCRCDRHSRIMLLLKAVKKSHLAHLAK

SEQ ID NO: 3939 - protein, 81 aa, synthetic construct
RFKLLPKFLKRINKWTRRQACRWQACRRWRALAALKYARCRNTAGSMYAAEQLLKVLCSRFRLRRKRMKVKLDFRKLCSAT

SEQ ID NO: 3940 - protein, 71 aa, synthetic construct
ILRFIKKLLKRIRREKTVFAKAKRLGRLKDICDKAKQCLTTELKKAIQARGRWRHATANWWAPLEALRFCL

SEQ ID NO: 3941 - protein, 32 aa, synthetic construct
WLRFFRKYYRLWRTLRARLKWVRALQAGLVAT

SEQ ID NO: 3942 - protein, 21 aa, synthetic construct
KLKMLKKLMRKLKQQLCFLLH

SEQ ID NO: 3943 - protein, 83 aa, synthetic construct
KFKLLTRYLKLWKRRKARMQRLNRNMKATASQRKAAKRRAKIGFTLWAQMVWRSAKLLLSLHATVLSEELQAYMLRKTGLKNM

SEQ ID NO: 3944 - protein, 35 aa, synthetic construct
LLKILRKLYRMMKPLAAKRTSWKSWLVMTLINRRA

SEQ ID NO: 3945 - protein, 20 aa, synthetic construct
WFRFLKKWLRLFKTAPGKKL

SEQ ID NO: 3946 - protein, 72 aa, synthetic construct
RWRFYRKLLKKLNSALNGWDLQRLAVVLLLWLRKNALRFSKPVCKSLNDKTLHRRLFNAAKAKRCYRKMKKE

SEQ ID NO: 3947 - protein, 49 aa, synthetic construct
RWRIMKRMLRMMQRIDKVENLCILRRFLKHWARKAAALRPLKMSLYGAL

SEQ ID NO: 3948 - protein, 39 aa, synthetic construct
KLKFLKRLIKRFKKMTRLGRDAKTLYCEKLAAVKKAAAV

SEQ ID NO: 3949 - protein, 54 aa, synthetic construct
RYRIMKKWFRWFRRRAHSLAAALNKRLQIFKRRTARKSVKADNAECLLKKEQLY

SEQ ID NO: 3950 - protein, 28 aa, synthetic construct
RFRLMQRILKLLCRAWRHCKAGLLNFLN

SEQ ID NO: 3951 - protein, 56 aa, synthetic construct
WFRYMSRFFRIFNTRKKAKLSLRKLKRAAKAKSWLFLSRMRKVLARYWIPAEEGRL

SEQ ID NO: 3952 - protein, 67 aa, synthetic construct
KWRFIQKLLRLMKCERKANLAEKWRQWQRPKLYRLKWLAKSDHKLKWKFEWKLCLACRYMRSIASAA

SEQ ID NO: 3953 - protein, 48 aa, synthetic construct
KFKLLKRWYKRLRNLTLLKNAKAKKKVKTCRLARVLEVHWNAEFSSIY

SEQ ID NO: 3954 - protein, 28 aa, synthetic construct
RYRIYRRLLRMLKKKLCDCDRARALLNA

SEQ ID NO: 3955 - protein, 50 aa, synthetic construct
RFRFMCKFLRIFRRALGPGARRFRFDWKLAALATLIHLKACRFRWNKRKA

SEQ ID NO: 3956 - protein, 60 aa, synthetic construct
RLKILRRFYKLLCSEPYKLMWETKLKYYKRALVRRAALVAMLAHFASKLKNNLMAPKGIY

SEQ ID NO: 3957 - protein, 69 aa, synthetic construct
KIRLWRRYLRLLNRAHALRRLFKTTKLAVSKAASKDLKIKAIRRDEVKKCLALWPKFGERKIPALMALF

SEQ ID NO: 3958 - protein, 81 aa, synthetic construct
RMKLLKKYFKKFCRWLALRAGIRLKSKAPQHSKTPSKVWDLACRDAREWLDLLKNRLRDRHRDKAHFARLRKQRLIFCTLD

SEQ ID NO: 3959 - protein, 52 aa, synthetic construct
KFRMFRKLMRKLNNIQAALRYAATRSKWALARYLSASKSFRNKIKLMRKASW

SEQ ID NO: 3960 - protein, 60 aa, synthetic construct
RLRMFRRYLKRLRKCHPKGTDKPLYTWIIRKASNKHPLDALIKKRAMKSQFILKRLLKLA

SEQ ID NO: 3961 - protein, 46 aa, synthetic construct
KMKFLRKWFRLLKKGDRARWALKSCIYVLAARTASRKDWKLTKNAM

SEQ ID NO: 3962 - protein, 54 aa, synthetic construct
MFKFIKKWIKKYNKLLYCFRLAALAILRSGFAVSVARLSKDKLRRKCLPVALLL

SEQ ID NO: 3963 - protein, 69 aa, synthetic construct
LYRFLRKILKWFRSACMKLRKRKGQLHVLSKLAWHIFKKDGNLRLTTLWLRVLAVRTRKLKIACLKVWK

SEQ ID NO: 3964 - protein, 87 aa, synthetic construct
LLKLLPKYLKFMTRALLRKRKSHLRVRKAALQVARRTRDRMIARAASLPLCKAKKYKMKKLWRQKKMARGQHLSLWKFKASYARKTP

SEQ ID NO: 3965 - protein, 68 aa, synthetic construct
RWRMLRRYIRLLRKRANHKAAKPLEWNRGDNYKRLGAPLKRKSRMIGRLDLYYKANKYVMDLKPLKLY

SEQ ID NO: 3966 - protein, 39 aa, synthetic construct
LLKYFKRIYKLMSKKREAQWRRRGLLDDSAMAPATATRA

SEQ ID NO: 3967 - protein, 29 aa, synthetic construct
KLKLLCRLWRKYNQKRLFYDGMNAARWKM

SEQ ID NO: 3968 - protein, 57 aa, synthetic construct
FLRLLKKLFRFFKKAGKLKWNTRRCGYKLHDLEPVKKRRFAYAGLRRMIEKAVLILS

SEQ ID NO: 3969 - protein, 75 aa, synthetic construct
LYKFLRRLWRFLKSPASAVKGTRIDILKLRKRRLRRDVRRKREDQQALQMLAKHAITRCRSMALLLNKIGIGARF

SEQ ID NO: 3970 - protein, 20 aa, synthetic construct
MMRMLRRMLRRLQRMKLVAC

SEQ ID NO: 3971 - protein, 23 aa, synthetic construct
LLRLLRRLIRRWSQKPTRLIHQM

SEQ ID NO: 3972 - protein, 22 aa, synthetic construct
KLRLLTKMLRRYKTSADLFYHR

SEQ ID NO: 3973 - protein, 67 aa, synthetic construct
RMKYFCRLFKIIRRGKWDILNKFCSSRHKNAKNALINRRLRDKKARLIMRYAFKALMALRADKAWIA

SEQ ID NO: 3974 - protein, 23 aa, synthetic construct
KLRFYTRYMRFLRRTLKLAKAAR

SEQ ID NO: 3975 - protein, 44 aa, synthetic construct
FMRLMRKLLRMLRTKHAAHKLNDLKLEKTCRAWILARDLAPYMQ

SEQ ID NO: 3976 - protein, 24 aa, synthetic construct
MMKLWKKWLRLLKHKVASLYPEAA

SEQ ID NO: 3977 - protein, 32 aa, synthetic construct
LFKILSKYLRRLSSAECIIFAKAAVRARLKCD

SEQ ID NO: 3978 - protein, 53 aa, synthetic construct
WMRYLKKMLRRLQRHKPSRMPRWLRHFAKNQANYKKRLQKQQAAAMAKRCRAL

SEQ ID NO: 3979 - protein, 58 aa, synthetic construct
RLRFMTKWYKKLRSVAAARRAVHARAPVKGLAAICMRRKTDAGLKRRHQHAHALWAGL

SEQ ID NO: 3980 - protein, 23 aa, synthetic construct
WLKFLKKYWKRLKRALSFKHFAD

SEQ ID NO: 3981 - protein, 91 aa, synthetic construct
FLKLLTKWFRWWPTVPKRLNIRRPKKNLRAHRLIIKGGAQRLKRKLREKLLLEPELAANARKHKHQLLIKAAAYEKTLAKLKDDKSIFNVE

SEQ ID NO: 3982 - protein, 51 aa, synthetic construct
RLKFLPKYYRKFTKAAGALVRCAHWLFICVAKLSKLRKMKRDWQRKLKCAK

SEQ ID NO: 3983 - protein, 48 aa, synthetic construct
KWKLWKKFLRKLKCALERNNRLRLLKRMSLLADSDATHIRKLRRLKRW

SEQ ID NO: 3984 - protein, 27 aa, synthetic construct
KWKLYPRLYRRWCRLRAAMALRAHLYK

SEQ ID NO: 3985 - protein, 61 aa, synthetic construct
KLKLLKRYLRKYKRMKLVRAKALGARAALPLSNRMRAAHLCLRMKSNAMKLLTAMRTEWLI

SEQ ID NO: 3986 - protein, 95 aa, synthetic construct
RMRLYTRMYKLLHRIAVHFGNMKRFLKYARRLGRAKAHMLLLVPKMLARRLLQPVKKHDRMGTKRFLTRALKKAHKVFNLIARGARDYRRTLVAA

SEQ ID NO: 3987 - protein, 70 aa, synthetic construct
RYRWYRKFLKKLRCQSAMKLLRKGRACAHKPALALLMKMAHVRVKREKRRVCRLDRNNMAHGLSSKQDRL

SEQ ID NO: 3988 - protein, 54 aa, synthetic construct
MMRIFRRILRKYKKLACTKLWILAMRTAHLVKTARLLHAHARDSIWRMGIRAAA

SEQ ID NO: 3989 - protein, 21 aa, synthetic construct
KLKLLRRMYRRLRKLILSWDQ

SEQ ID NO: 3990 - protein, 88 aa, synthetic construct
RYRLYKRLFKRFQTLYKRPALWAKHFPCLAIVCMDKAGLAKWKKWAKKLWAKLAMRPLWRRRLFAALARMKLISIQSLIRGDWKRELR

SEQ ID NO: 3991 - protein, 41 aa, synthetic construct
RMRLWRKLFKFWSCLKPALTEKDAARKNMKQKLCGAARKKV

SEQ ID NO: 3992 - protein, 51 aa, synthetic construct
KLKLWRKMLKMMQRKHHAVWATANRQKLPLHSALRQVLRRKAKHATCKKRY

SEQ ID NO: 3993 - protein, 34 aa, synthetic construct
FLKLFSRLLKLLKRLSKTDLQQWKRLIAPTALRM

SEQ ID NO: 3994 - protein, 35 aa, synthetic construct
IFKFLHRWFKKLRQTKLRRITAARTPLAKVANAAS

SEQ ID NO: 3995 - protein, 22 aa, synthetic construct
LWKLWRKLFKLIKKHHARAGKE

SEQ ID NO: 3996 - protein, 29 aa, synthetic construct
KIKYMQRLMRKLRRYALKWCSLDAFAVAL

SEQ ID NO: 3997 - protein, 63 aa, synthetic construct
KFKILKRFLRLIKRWGTKKDKLFDPEAPRKLSLAVEFEPRARALRRYIRNTLPLKLACPMARF

SEQ ID NO: 3998 - protein, 34 aa, synthetic construct
MLKFLRRLIKILSNCAHLARAFQKKAALDAHHKK

SEQ ID NO: 3999 - protein, 36 aa, synthetic construct
RWRLLKRFMKKWNRIKCNRLKWKPFAHCKYSALLAA

SEQ ID NO: 4000 - protein, 32 aa, synthetic construct
FLRLFSRLIRLLQHLKAPARCGKKRRGVGKWC

SEQ ID NO: 4001 - protein, 25 aa, synthetic construct
LLRLFPRLFRRWRRAKALADKRLHC

SEQ ID NO: 4002 - protein, 43 aa, synthetic construct
MFKFLKKWLRLMRKSLAYQQEAQLLFARPRCAKLTKKAPKDKL

SEQ ID NO: 4003 - protein, 52 aa, synthetic construct
KLKMLKKLLKRFRNFKVIREYSHERAAQTRLLAKACMEKASAKFTCGHLIAK

SEQ ID NO: 4004 - protein, 41 aa, synthetic construct
RYRFLKKMLKRMRKALLADREGLPDASMAFAGLMCSYALRH

SEQ ID NO: 4005 - protein, 25 aa, synthetic construct
KLKLLQRFLKLLPNWKARMVRKTLS

SEQ ID NO: 4006 - protein, 36 aa, synthetic construct
KYRMLHRLWRLFSKNQALAAKCVPRAAHFEKMKGLR

SEQ ID NO: 4007 - protein, 21 aa, synthetic construct
LLKYWKKFYRRYRKLDYQAML

SEQ ID NO: 4008 - protein, 83 aa, synthetic construct
KWRLLKRMWKRFKRNARKSRAKALKELHAAKSRKLDNYLGWFLRVKKVWLRATFKKRHMGKNPAIRNVHQHSAQRWDLKCNAA

SEQ ID NO: 4009 - protein, 24 aa, synthetic construct
RLKLWRKMFKFFRKANALSAGEAC

SEQ ID NO: 4010 - protein, 22 aa, synthetic construct
KLRLISRWYKRIRSPEALLRAY

SEQ ID NO: 4011 - protein, 27 aa, synthetic construct
KWKLYCRLLRKIKPWSYRALLRLKPAK

SEQ ID NO: 4012 - protein, 85 aa, synthetic construct
KLRMYHKLMKYLNTALKKQARLNLLTLEMKEVLRGLAKRRLALAAVFWNAHCVLTKQACGYLARNEYRDKPGRACDAKRFLLKSL

SEQ ID NO: 4013 - protein, 89 aa, synthetic construct
KFKYLRKYIRFLKTAKAWRGYERKRVRARHKHENIKARLGLFTILRVILVKRAALWGAPKRIRLDLRPFLVDRLAISLALKGFLGKKTQ

SEQ ID NO: 4014 - protein, 67 aa, synthetic construct
KLKLLRRFFKFIKKFRQARGLKAWKLALKLANKMREREFNGFKGLSFNRPGLMVNLHKYRLANATWR

SEQ ID NO: 4015 - protein, 46 aa, synthetic construct
LFRLLRKLFRKMKKKFNKMAATWDNLLGGPLRKKAASRALKIARDD

SEQ ID NO: 4016 - protein, 37 aa, synthetic construct
FLKWYKKWWRWLRHLRYKRFAALIKKLTLCLLSKKDN

SEQ ID NO: 4017 - protein, 58 aa, synthetic construct
KLKYLPKLMRRFNHIRKARRLLANKLAARCNCMYRKLEKQVAKGEKTKYTGMGLIKLC

SEQ ID NO: 4018 - protein, 40 aa, synthetic construct
KYKWFHRWLRKLSSRKLGRLAPSLRHLQLGARIAAAHDGP

SEQ ID NO: 4019 - protein, 37 aa, synthetic construct
KYKWLRRLLRLFCKIFMMRESRKQLAKRAQGEAAVYA

SEQ ID NO: 4020 - protein, 58 aa, synthetic construct
MFKLMTRYIRKLKCDKNQKLACDVKAVRLKGDAIGAFKVPLATARLRAAAFDRAWKHL

SEQ ID NO: 4021 - protein, 27 aa, synthetic construct
KLKLLKRILKRLPRKLAKTANCEFQFR

SEQ ID NO: 4022 - protein, 26 aa, synthetic construct
KWKFFSRLLRMIKCTLLKARANANKV

SEQ ID NO: 4023 - protein, 36 aa, synthetic construct
KWKIWRRLWRFFKKRKRAYRHKAAYAALHMGPGWLL

SEQ ID NO: 4024 - protein, 39 aa, synthetic construct
MWRLWKRMYRLWKRLPFRADWKARSLWPKVRLFSKALLA

SEQ ID NO: 4025 - protein, 27 aa, synthetic construct
LYRLIQKYLKFLRKARCAKFGGRCKDA

SEQ ID NO: 4026 - protein, 20 aa, synthetic construct
LYKMMRRLMRLLNKRQLWMY

SEQ ID NO: 4027 - protein, 44 aa, synthetic construct
RLKLWSKLIKRWPRHGCGLCQRAAFLKALKAKSEARKCLFQWKN

SEQ ID NO: 4028 - protein, 43 aa, synthetic construct
YYRMFKRFIRRISKKYCRELRKWLIAPLLDLPQPALLLKKRLY

SEQ ID NO: 4029 - protein, 45 aa, synthetic construct
RYRMLHRMLRRMRHLLKKVDDRPRRAAQGKLYLHHWAEALYRLLR

SEQ ID NO: 4030 - protein, 41 aa, synthetic construct
LIKLYRKYMKLMKPLRTFSRNTLELSYLLTNYALKRKRAWR

SEQ ID NO: 4031 - protein, 46 aa, synthetic construct
RFRYFKKWLRIFCPWLRLDRLAKRAAKYKTKMAINKFLRRAFAQLI

SEQ ID NO: 4032 - protein, 67 aa, synthetic construct
IMRLLKKFIKRIRCHAMHFRRYKLKLGARQLKSLQNRAALGLAAYLRLLLCGECKLSARDRDRGFIR

SEQ ID NO: 4033 - protein, 20 aa, synthetic construct
ILKIIKRLWKLLKQMRCASN

SEQ ID NO: 4034 - protein, 87 aa, synthetic construct
KFKLMKRMMKKWKKRAKLMAMANRANAFCAASARAIFYLLIWGIFRLLVGRRAEKFLAKCHVRKNLYRQLLLIVRVKARLLIWARGC

SEQ ID NO: 4035 - protein, 25 aa, synthetic construct
RWKLLPRFWRKYRTDLLAVYQRLAK

SEQ ID NO: 4036 - protein, 85 aa, synthetic construct
YWRYYCRFWRKFKKVLNKLRRATTMKWLCLNAFRSWDRWEGHRLRARGLWLALYAAKLRKRTAWKKAAACSRKCFSMKKVLFTKK

SEQ ID NO: 4037 - protein, 39 aa, synthetic construct
RMRILKRIIRKFRSLLAHAAAKRRYDRARPHNLPFALLK

SEQ ID NO: 4038 - protein, 22 aa, synthetic construct
KLKLFSRMLRLWCRQYLLRESR

SEQ ID NO: 4039 - protein, 51 aa, synthetic construct
KLKIIRKFLRLINRAQARAGKQMDAQIRARVRLPERAMANPSRPHAKKAWL

SEQ ID NO: 4040 - protein, 33 aa, synthetic construct
RLKFYRRYIKRLRKHIRLWILNKLAFLAYTLPT

SEQ ID NO: 4041 - protein, 47 aa, synthetic construct
YIKILQKYIRLLKPHAKLAAKFLKWRDWAGILLLRSRSRMKFRRMKR

SEQ ID NO: 4042 - protein, 39 aa, synthetic construct
KLKLLKKFFRRLTKDKKPRNWAGATNLTARLAAIKPTLQ

SEQ ID NO: 4043 - protein, 43 aa, synthetic construct
RIRLMKKLLKRFQNKVCRSWHALKGASKDACRGLCHRLYAAKR

SEQ ID NO: 4044 - protein, 81 aa, synthetic construct
FLRYMKKMWKKLTHKKTLDKYWASTRARNQKLLYLKDRRGTQKRLPEAKRLRLARKFDALSKLVPTENARDKLRKILKIQD

SEQ ID NO: 4045 - protein, 30 aa, synthetic construct
KLKWWRKLFKKLTKCLKLEALLVRCDARKD

SEQ ID NO: 4046 - protein, 59 aa, synthetic construct
FMKLYCRLWKKMTSRRRARYLAALAILLKFPKMTESSSRPKKWWMWALLCFRRKDLKKK

SEQ ID NO: 4047 - protein, 85 aa, synthetic construct
KWRFLCKMIRLIRSAFKALARNKSKKCLQYAKLARNQKTDLAFRARLLYRLKPLTAAMKKHKKMDCNRERVICRCANDKFIAARR

SEQ ID NO: 4048 - protein, 40 aa, synthetic construct
LYRMYPRLLRIFTRKLMKHDLAKGAPRLAKEKCLRMWGKK

SEQ ID NO: 4049 - protein, 73 aa, synthetic construct
LLRIIKRWIRKIKNKSALKRVCVAAKSALMRNAAIKLLMLCDKRIIRKDRPYRYYCLHSHCLRHARSKAKLLR

SEQ ID NO: 4050 - protein, 38 aa, synthetic construct
MFKMLNKFLKRFRHAWKNRLLRLLANCRYRVKWKKLLL

SEQ ID NO: 4051 - protein, 34 aa, synthetic construct
RLKLFNRYLKRIPTPKEKELFLKASLYRKLLPLH

SEQ ID NO: 4052 - protein, 25 aa, synthetic construct
LLRWFNRWLKKMRHNKHHILKFRAL

SEQ ID NO: 4053 - protein, 24 aa, synthetic construct
LYRLLRRLFRRFNKVELMHLKKDF

SEQ ID NO: 4054 - protein, 35 aa, synthetic construct
RLKIWRRLYRRIPSKKHAATKDAAATLNASSKWLK

SEQ ID NO: 4055 - protein, 32 aa, synthetic construct
KMRWFTRYIRKYRTLNAGKVRKARLFAQYALL

SEQ ID NO: 4056 - protein, 38 aa, synthetic construct
KWRMLRRWFRRWRRKAKRPAALKLRPLVCLPWHLWLGA

SEQ ID NO: 4057 - protein, 33 aa, synthetic construct
RLRWLRKFLRKFKTLLALKQKRIKCAMDCLWSD

SEQ ID NO: 4058 - protein, 21 aa, synthetic construct
LWRLMPKYMKKLRKNLNAKLH

SEQ ID NO: 4059 - protein, 24 aa, synthetic construct
KMKLFHKFWKLIKKNPKLKTANAA

SEQ ID NO: 4060 - protein, 43 aa, synthetic construct
WMRILKKLFRKWSNAKSKLFKLHALAKMKASATSRFAGYTALW

SEQ ID NO: 4061 - protein, 40 aa, synthetic construct
RWKFMKKLFKLLRSRTDKMKIGATNRCACALPALANIKRK

SEQ ID NO: 4062 - protein, 33 aa, synthetic construct
RLKLFRRFLRKLSRRNAAFSNTQRKPHLKAAKA

SEQ ID NO: 4063 - protein, 51 aa, synthetic construct
IIRLLRRLYKKWSCAKALVLAQMKTRDDNKALADLDGLAKKALNGKKYRIQ

SEQ ID NO: 4064 - protein, 30 aa, synthetic construct
KFRLLKKILRKWHNAKLGQLSNGTRFLLVA

SEQ ID NO: 4065 - protein, 20 aa, synthetic construct
RWKWLNRIFRYLRRAAEKAQ

SEQ ID NO: 4066 - protein, 21 aa, synthetic construct
RLRYFRRLLRFMKHQASYGAL

SEQ ID NO: 4067 - protein, 50 aa, synthetic construct
LWKILRKYWKILSRVKSYKLEKRLNKLAFCQALGLLKRFTARRKLKKFWA

SEQ ID NO: 4068 - protein, 56 aa, synthetic construct
LWKLLKRILKLIKCLWMKHEALVTRRGKMRKAAKLKYLAFAARRKLRKMAVLKPAQ

SEQ ID NO: 4069 - protein, 30 aa, synthetic construct
LWKLLPRFLRRIHTYKYNYRLAAWRARRSM

SEQ ID NO: 4070 - protein, 39 aa, synthetic construct
RLRWFKKLLKKFKKLSLPKGLARKKWEYLYFKLFAPLCV

SEQ ID NO: 4071 - protein, 23 aa, synthetic construct
KWRLFQRILRKLKQYAEHARLFR

SEQ ID NO: 4072 - protein, 25 aa, synthetic construct
RYRMWKKWLRYLRRARLPLYTLAKW

SEQ ID NO: 4073 - protein, 34 aa, synthetic construct
RFRLIRKLLRLLKKWNPKELKKVPASMASRRELN

SEQ ID NO: 4074 - protein, 21 aa, synthetic construct
KYKLLCKYIKRLNKLFARLKH

SEQ ID NO: 4075 - protein, 42 aa, synthetic construct
FLRLLCRLFKRYNKRLRYKVIKKNAFLPCKKESARVYALKNQ

SEQ ID NO: 4076 - protein, 23 aa, synthetic construct
KWKYYQRFLRLWRQAALCRQGAK

SEQ ID NO: 4077 - protein, 49 aa, synthetic construct
FLKLYKKLIKLYQSVRAKVAPDLKRLHVKPEMKKAEGAKRPKLMRSAAL

SEQ ID NO: 4078 - protein, 30 aa, synthetic construct
FWKLLRRWWRKFRRTKAYYCAKAAALGSRQ

SEQ ID NO: 4079 - protein, 45 aa, synthetic construct
MYKFIRKIFRRLKNRKPKLILLASRRAAAKAAKAFMLIRIVKAAC

SEQ ID NO: 4080 - protein, 32 aa, synthetic construct
KWRLLRRIFRWLRKCHTMRAAELDGYCRRLQA

SEQ ID NO: 4081 - protein, 42 aa, synthetic construct
KLKYFCKWWKKLRQEEAAPLRIALNRLEARRMANALRRHFMK

SEQ ID NO: 4082 - protein, 83 aa, synthetic construct
KMRLYNRILKFMTTTKTALAWDDKWAKKKACKIEWAKKARAPRAYFKKACKGTERPKALLSKKCLPVKLLPAKLEKDYRMKAQ

SEQ ID NO: 4083 - protein, 49 aa, synthetic construct
RFKLLCRFWKRLHNRFAWMNCDLKRRKNLWLKVWATLHMARMADRLQLR

SEQ ID NO: 4084 - protein, 34 aa, synthetic construct
KFRLLCKLWKKMKHVWKLLATAEDKRQPAAQNLA

SEQ ID NO: 4085 - protein, 27 aa, synthetic construct
LMRLLRKFMRKFKQRLQRALASTEEAP

SEQ ID NO: 4086 - protein, 22 aa, synthetic construct
RLKLFSKMLKKLHQAHLERAAF

SEQ ID NO: 4087 - protein, 21 aa, synthetic construct
FLRLWKRLIKRFKTHAKTARA

SEQ ID NO: 4088 - protein, 57 aa, synthetic construct
KFKYLSKMWRRMQQACRMFLLNYAWCNCTKSPLARRTANSFVKRLRLARKLKKRLLA

SEQ ID NO: 4089 - protein, 82 aa, synthetic construct
LFKLLKRILKKFNRFILIDYPLKYSRMSALELAALESKKRKGNNLDIRLKTVLVPAAYRYKKKRSSRLRLGARLLASDRAWA

SEQ ID NO: 4090 - protein, 20 aa, synthetic construct
KIRLLHRWLKRFHSPAARRF

SEQ ID NO: 4091 - protein, 42 aa, synthetic construct
RMKLLKKLMRILRKYAERRFLAGCALKMLLFELLKRDARAEL

SEQ ID NO: 4092 - protein, 25 aa, synthetic construct
LMRMFKKILKRLKQLMKLVQSHPLA

SEQ ID NO: 4093 - protein, 33 aa, synthetic construct
KIKLFKRWLRRLRSCHNKSLKRNEALMLRKANA

SEQ ID NO: 4094 - protein, 24 aa, synthetic construct
RIKLLQRILKRLRKFKALILVNCV

SEQ ID NO: 4095 - protein, 58 aa, synthetic construct
RIKLFRRLIKKFQRLLWKRKPMMNGPLVAADKALYGAPRERKKLNLGEWSKLNSRLKA

SEQ ID NO: 4096 - protein, 41 aa, synthetic construct
RWRLLNKFIRLWKNALHCAAKKLVAKAARAMLDRRTTLGCA

SEQ ID NO: 4097 - protein, 23 aa, synthetic construct
LFRYWRKWYKLMKHQGRHARAAA

SEQ ID NO: 4098 - protein, 30 aa, synthetic construct
RLKLFKKLYKFIHRRANLCLGGIEDAKKVK

SEQ ID NO: 4099 - protein, 56 aa, synthetic construct
LMRYFKKLLRRFKKQIKMALLRVKRLKLLALKGRVFTLKLAFKLTTRWRLERWLVL

SEQ ID NO: 4100 - protein, 73 aa, synthetic construct
RFKYFRKMFRLFKRAKTCDALYKLERFLQTDKKRLIRREDAYNKMRLFNAIRLTLMQSARLARRNLAEARMNK

SEQ ID NO: 4101 - protein, 40 aa, synthetic construct
RYRMFQRLLKRMKPDALQWRRFIAVCLKLASANKKKHLAQ

SEQ ID NO: 4102 - protein, 97 aa, synthetic construct
LMKFFCKFMRLLPCFALYVALSAKTKECVLMNMMILKTFLRKALLADIAPEGRGAWKRLKRKQPLLEDLGHLKHLKAARRRARSVKLMLCRKAVHAR

SEQ ID NO: 4103 - protein, 24 aa, synthetic construct
FLRFMRRLMRLMRRKTALAAKLSH

SEQ ID NO: 4104 - protein, 21 aa, synthetic construct
LYKILTRFYKMLTRDKRALPL

SEQ ID NO: 4105 - protein, 40 aa, synthetic construct
KLRFWRRFLKKFRNKGFVAQLGKFLMARWKEAKHVMAKPA

SEQ ID NO: 4106 - protein, 47 aa, synthetic construct
KWRFMRKFLKRFNSAMSKAAQNARHMAAYRNAVSLLKHKLRLLNFIK

SEQ ID NO: 4107 - protein, 24 aa, synthetic construct
WLRFWRKLFKRMRRSKPYALACFA

SEQ ID NO: 4108 - protein, 29 aa, synthetic construct
FLRYYKRMLRRLRNSWDQKKKAHAAFDAC

SEQ ID NO: 4109 - protein, 22 aa, synthetic construct
KMKWYCKLLRLISKWAYANKKA

SEQ ID NO: 4110 - protein, 33 aa, synthetic construct
RWRLLRRFMRFLKKAVAFAKIPRKCNCAKYEMA

SEQ ID NO: 4111 - protein, 41 aa, synthetic construct
LWRILKKMLRKYNQRGLRCFLSVRAVDKARRLCLSMEALAA

SEQ ID NO: 4112 - protein, 38 aa, synthetic construct
LLKFLRRLLKRWRRHKKLAALKAKDRDVLPDCLARKLM

SEQ ID NO: 4113 - protein, 26 aa, synthetic construct
KLRLLRRLLRRFKHEASRLNLTKRAI

SEQ ID NO: 4114 - protein, 37 aa, synthetic construct
ILRFMKKLLKRLQRTYKTTAFTHSHHNLKKILKLKKL

SEQ ID NO: 4115 - protein, 33 aa, synthetic construct
KLRWFSRLWRLFNNLGHKLTKLVKLTWLLAKWR

SEQ ID NO: 4116 - protein, 32 aa, synthetic construct
YFKFICRLFRRLHKQRLAKRRYLKRAKGLAWL

SEQ ID NO: 4117 - protein, 36 aa, synthetic construct
RFRLLNRLLRLMNKKRARWQSLNLKVSKWGHTFAAM

SEQ ID NO: 4118 - protein, 46 aa, synthetic construct
FIRFWKKLMKKLKRMRLLLLLGRFAAFQDDAGSHKCILRRMAKHVA

SEQ ID NO: 4119 - protein, 44 aa, synthetic construct
RYKWLCRLFRLIHPPNAAWKDLERLELHFHARSRRKVAAKRRWR

SEQ ID NO: 4120 - protein, 64 aa, synthetic construct
KMRFWKKLWRLLRRMEKRRRDLGYRWRLRNANQIQLPYALRSKRRLNLLATAMAKLRLAWNKIT

SEQ ID NO: 4121 - protein, 38 aa, synthetic construct
KLKFFRRLLRWMRKYMAFGTRWLPNTTLRPAKGLRAQR

SEQ ID NO: 4122 - protein, 22 aa, synthetic construct
LMRLIPRLYRKIPSACAHKRLR

SEQ ID NO: 4123 - protein, 25 aa, synthetic construct
MLKMLRRFLRRLKKTRASANLPIVF

SEQ ID NO: 4124 - protein, 39 aa, synthetic construct
KMRLLRRWLKYYRTLRFACRRRLDHGLMQGFNLLKYLAH

SEQ ID NO: 4125 - protein, 52 aa, synthetic construct
RYRLYNRYYRLYKHLRRTRAKQDCLQSHDGRAKRLKLQAWDLWLLRRLFAQE

SEQ ID NO: 4126 - protein, 27 aa, synthetic construct
LMRYLPKLWRKLNQLRKLQLEPLDLKR

SEQ ID NO: 4127 - protein, 42 aa, synthetic construct
KLRMYHRLYRLIKKLGMTKRPKLIKRTALLIMNNRQDLKRAM

SEQ ID NO: 4128 - protein, 78 aa, synthetic construct
RLRLLRKLIKYIRHIVATCATRKSRCLHMICALLVKTIAMARHPTLKAAQSKLWAEKLLARPKRALRPLVMIVYIPAL

SEQ ID NO: 4129 - protein, 23 aa, synthetic construct
KMRIYRRLIRRMQPRLAAWQHLA

SEQ ID NO: 4130 - protein, 92 aa, synthetic construct
RFKYWHRLLRYFPKLLWLLPRRAQLWLRRATWIWRSLHALKRSKHQHKVKAKWAMRAAPRRRADVWIYAYLFNEPLQKVTAQDKKKAALFKA

SEQ ID NO: 4131 - protein, 40 aa, synthetic construct
KLRYMTRWLKLLSKSKAKIKYRAASTLGRRMKHWLGALDN

SEQ ID NO: 4132 - protein, 41 aa, synthetic construct
ILKFLCRWFKKLSKLAPLRKRQGHQASLKLALSAWLLKITH

SEQ ID NO: 4133 - protein, 41 aa, synthetic construct
LLRWLRRFLKKYKNCPTQVAIPRKRASAKEYDLLRTRIIKL

SEQ ID NO: 4134 - protein, 63 aa, synthetic construct
LLRLFTRILKFMRQVAWQARGHFRRKALAATWLEKKVARRMTACLAKLTRRALRYVVEEHKVV

SEQ ID NO: 4135 - protein, 60 aa, synthetic construct
RLRIFTRMLKRLTPKKAKRAQRIWPRSACLAMPRLGLLRKWRVAAHAEVCTDLAFLRRDA

SEQ ID NO: 4136 - protein, 44 aa, synthetic construct
LFKMFKRYLRKFRRARYLLLLGATARLKWLRLAIERALNRYKAA

SEQ ID NO: 4137 - protein, 97 aa, synthetic construct
RYKFLNKLLRKIRKEVVTIARFKFLLASRRMYKAATRLERRHETQPKMGALDLCGKADALKYAAKLRLWGSNQLKFYDADVQALLLLWVREVKKRRR

SEQ ID NO: 4138 - protein, 20 aa, synthetic construct
KLRFMRRMWRLLHRKNVHLA

SEQ ID NO: 4139 - protein, 29 aa, synthetic construct
LWRWFHKLLRMLSPKCGHNALRLKQNKLR

SEQ ID NO: 4140 - protein, 29 aa, synthetic construct
MWKILKKIYRKLKRAVLCLHLKAKTSRLA

SEQ ID NO: 4141 - protein, 62 aa, synthetic construct
KWKMLRKMIKLIPRRDNLFKKQDMALCKHKKKLSLLRYRHLTAAALDKATLPLHLWRVAWYL

SEQ ID NO: 4142 - protein, 21 aa, synthetic construct
IWRLFKKFIKLLPKWAARHAD

SEQ ID NO: 4143 - protein, 63 aa, synthetic construct
FFRFLKKLFKRLRRLLGQLSTLAADMDREKARVKIKILRRRAWAAWRGLATLLRVDAHKGLEH

SEQ ID NO: 4144 - protein, 38 aa, synthetic construct
KWRLLRRIMRKYKKLRQLRLRLALETDRFMAKHKAGLH

SEQ ID NO: 4145 - protein, 32 aa, synthetic construct
KLKLLRRFWKKYKSAKWAVVTFRRPAIANCLI

SEQ ID NO: 4146 - protein, 88 aa, synthetic construct
RFRLLTRLLKRIRPRKCIRALALMRIKRAASAKFHLLSPIHAPYIKKWAAYKAKDAFLKASKAKLATRCKFMWAQNHKPNKADRMRFL

SEQ ID NO: 4147 - protein, 20 aa, synthetic construct
RWRYLSKFLRRYTKELPALV

SEQ ID NO: 4148 - protein, 58 aa, synthetic construct
KFRWLRKLLRRWKKELKFFRAFLRQYKTRMNERPALFACRDSAAKQKTGNARSLEAYC

SEQ ID NO: 4149 - protein, 36 aa, synthetic construct
KLKFYRKWIRWLRRLANALRLDGLNRASGTLKKSWS

SEQ ID NO: 4150 - protein, 40 aa, synthetic construct
WFRYLRRFLRFLRHLPMRLSARQRWHAHRGLVARACCRDL

SEQ ID NO: 4151 - protein, 28 aa, synthetic construct
LLRYFPKMFRRLRRRTLAAGLLTYHAHK

SEQ ID NO: 4152 - protein, 20 aa, synthetic construct
RLRFLKRFFKRLSNLEECLR

SEQ ID NO: 4153 - protein, 48 aa, synthetic construct
RYRFMKKMLRFICKLKLLAAEALLRRATLIHRMPHAKLSMLCDRLPCG

SEQ ID NO: 4154 - protein, 35 aa, synthetic construct
MFRILKKWLRRWNKKIEARLCYRKYAWLLPRAAAN

SEQ ID NO: 4155 - protein, 55 aa, synthetic construct
RLRFLKRYLKRLCRVERQKCRKRAKLEWALASGAQGALNLYRRRACCDPPTDSKM

SEQ ID NO: 4156 - protein, 56 aa, synthetic construct
KLRWIQKWLRFWKSRKQPLALQNAMLYIPCARARAKGALACRRNVAHLTRLRLTNR

SEQ ID NO: 4157 - protein, 27 aa, synthetic construct
RLRMFCKYLRKWSTRARLKLDACAVTA

SEQ ID NO: 4158 - protein, 22 aa, synthetic construct
YYRLITKLLKRLTHLGDARRQL

SEQ ID NO: 4159 - protein, 23 aa, synthetic construct
RLRWFTRYLKRLKKANRLYASAI

SEQ ID NO: 4160 - protein, 69 aa, synthetic construct
KFKYFKRLFKKLPHAAKRLNRIKLVQRFLCALYHALANEQAKARDKKQKSGCWDDWAAKKRGMSKYKLA

SEQ ID NO: 4161 - protein, 39 aa, synthetic construct
RIKWLCRYLKLWRHVKFQAAYLDRLKRSLYKKNTLRAYH

SEQ ID NO: 4162 - protein, 24 aa, synthetic construct
KLRLWQRFLKKLTRKGWLDCAELL

SEQ ID NO: 4163 - protein, 37 aa, synthetic construct
KLRLIPKLLKKINRGFWKLIARLEKKAAEYRSQFCMA

SEQ ID NO: 4164 - protein, 35 aa, synthetic construct
FYKLIQKLIKFLKKRKLAVLNRRRCAKCLAGGLKL

SEQ ID NO: 4165 - protein, 20 aa, synthetic construct
KIKIYQKMLRRLQKLRNLLN

SEQ ID NO: 4166 - protein, 65 aa, synthetic construct
YFKFFHRWMRFLQRRFAERARKAIQACTLEYQLRRQAAYRRPKALHGLVFLTALRPIKKAARALA

SEQ ID NO: 4167 - protein, 25 aa, synthetic construct
KLRLFSKFLKFFRKCNRLYLARRSA

SEQ ID NO: 4168 - protein, 39 aa, synthetic construct
KWRWLRKWLKRLRRSQYNKKAKYAALLKPVPLTGKAIAL

SEQ ID NO: 4169 - protein, 27 aa, synthetic construct
LFKFFNKLLKFFRKLKNASNEQALKLA

SEQ ID NO: 4170 - protein, 39 aa, synthetic construct
RLKLLPRYLKRLRNKYFKQAIKIMANRSKWNHMLCALLN

SEQ ID NO: 4171 - protein, 29 aa, synthetic construct
IFKLLKKLMRFMKHARLATRRPHMDRAHS

SEQ ID NO: 4172 - protein, 23 aa, synthetic construct
RLRLWRRLLKRLKSKWLARNLTL

SEQ ID NO: 4173 - protein, 30 aa, synthetic construct
LWRLIRKMLRRMKPAFKAALTAGLWKQRVC

SEQ ID NO: 4174 - protein, 34 aa, synthetic construct
FLRILKKFFKRLRKLSHTACKRRGVKAAAEARNP

SEQ ID NO: 4175 - protein, 28 aa, synthetic construct
RLKLFRRIFRRFKTALAAKAKESDVRAC

SEQ ID NO: 4176 - protein, 48 aa, synthetic construct
FMRMLQRLFKRYKRLERLMAKHCEKGPLLLIKLILCMKWLEADWALLR

SEQ ID NO: 4177 - protein, 28 aa, synthetic construct
MFKWLSRLWKKLKKITAPAKDRAAFKLS

SEQ ID NO: 4178 - protein, 21 aa, synthetic construct
LIKFFSKWLKMLRRRSRYNLA

SEQ ID NO: 4179 - protein, 64 aa, synthetic construct
FLRLIRKMMKLYRRFNRRDANMSHPKALNRLKVPGLKLKFISKELCRRLPKALRMDCLAKLCGL

SEQ ID NO: 4180 - protein, 25 aa, synthetic construct
RFKLLCRLMKKFKSHLTRLNYTGAA

SEQ ID NO: 4181 - protein, 77 aa, synthetic construct
KWKLYRRYFRIIQKKGKPRRRAFALSRSRAIKRNMKFKQALYARKRFVLRLAICLKARDRTAWGQKANQDLDAEGHL

SEQ ID NO: 4182 - protein, 54 aa, synthetic construct
RFKFLNRYMKWYKKYAMYKHLAKARLAGCCLAPQLKNKKANLMFRRNLPLALKF

SEQ ID NO: 4183 - protein, 96 aa, synthetic construct
KLKLLRRMLRKMKKRLYLRCYDFRLAIKWVISWCLRCGYEKAYLFPVVGLRRRKGLMLPKPALIALKLDAGVLWFLRRARLLNRPVCACHERKGRR

SEQ ID NO: 4184 - protein, 80 aa, synthetic construct
RWKILRRWYKRLKRPALYREKAPVFFKAEYKHELFKRKWERKKAMRANASACLKRYGCARLMAPVLNQNARATILILSAL

SEQ ID NO: 4185 - protein, 23 aa, synthetic construct
KFRFMHKLYKLLRNRDKAAARAH

SEQ ID NO: 4186 - protein, 49 aa, synthetic construct
KFRLLNRLLKFFQRLKRRQKMLTLSKGEDMWKLDLRFLNAKAVKADARY

SEQ ID NO: 4187 - protein, 25 aa, synthetic construct
FLKWLQKLLRIMKKIADAAQRLRRN

SEQ ID NO: 4188 - protein, 38 aa, synthetic construct
KFKFFSRLYRWMKHLPPLRHRLAKRARLFEKAVDKQAD

SEQ ID NO: 4189 - protein, 22 aa, synthetic construct
KWRMLQKLLRLLQRKNFKYAHA

SEQ ID NO: 4190 - protein, 43 aa, synthetic construct
KLKLFRKWYKKMKRKMLPAALAASAAGINLKALLILREPCSVT

SEQ ID NO: 4191 - protein, 51 aa, synthetic construct
KWKFFRRLFRKFNKKAACRFQAKEYLPAIKGTRAKKLAFLLARYYKNKPGI

SEQ ID NO: 4192 - protein, 93 aa, synthetic construct
KLKFMKKMWKFIKKKVYRMWKARLARRKRRLNRMAPLAKNGAALSLLDTVVCHERHFAMLTFWFLLLHRKRKRAACKHLKAEFPHSLGKLKAW

SEQ ID NO: 4193 - protein, 30 aa, synthetic construct
RFKWMPRLWRFYKKPAAKLHGARTKAHAGR

SEQ ID NO: 4194 - protein, 59 aa, synthetic construct
KLKFYPRFIKRLKNLKKLVFSTARVLDTWRRELMARYMLLLWRRRRLLMDRAWALHMAR

SEQ ID NO: 4195 - protein, 34 aa, synthetic construct
KWRYLRRLFRIMRKHLCSAFCKMLAKLWVRVAAP

SEQ ID NO: 4196 - protein, 31 aa, synthetic construct
KLKFMNRWIKKFPTLPARALHASKAMALADR

SEQ ID NO: 4197 - protein, 35 aa, synthetic construct
LMRMLRRLLKLFKRKQLWATKANYGWLTEKRKKIL

SEQ ID NO: 4198 - protein, 25 aa, synthetic construct
KLKFFRRWFRILKQQLLPLPAEAEK

SEQ ID NO: 4199 - protein, 30 aa, synthetic construct
RLRLLPKMIRRLCHAIIRRYHRIKAKYLVI

SEQ ID NO: 4200 - protein, 74 aa, synthetic construct
KLKFLPRIYRRLTNKILLKYKKNFWMWSAKTAAAGQRCAGAAPRRWLKYRKIMGLNWWRMAPKILAKLRAMVRL

SEQ ID NO: 4201 - protein, 23 aa, synthetic construct
LLKFIKKILKLIKKKAVYAHAFK

SEQ ID NO: 4202 - protein, 28 aa, synthetic construct
LFKFISKFFRMLRCAWKDAWRARMLAKR

SEQ ID NO: 4203 - protein, 21 aa, synthetic construct
KFRLLNRLLKLYSRLSVYAVD

SEQ ID NO: 4204 - protein, 81 aa, synthetic construct
LLKFFRRFLKFLHKLRDLKAHRARLIVSINPFGRLLYLKGASADSAASLQRLLAKKGNVKDDQDRLRRKAMRKKTIAFGHI

SEQ ID NO: 4205 - protein, 35 aa, synthetic construct
RLRWLRRWIKKWKSHLLDDRKLHKSLEANLARSRY

SEQ ID NO: 4206 - protein, 22 aa, synthetic construct
KYKLFTKLLKRFPKAIELAWGA

SEQ ID NO: 4207 - protein, 96 aa, synthetic construct
KMKMLKKWYKFINPRKAKKLPSKAAAAHYRSRADKRWDVWMTAARKKDMLKDDYTHPFAVLRTAWRLNKPKAKARRTQALRPNKLWLNLKALAACR

SEQ ID NO: 4208 - protein, 36 aa, synthetic construct
LFKMFKRMLRKLKRCAVQFDYAKKAWLSKRPDALTC

SEQ ID NO: 4209 - protein, 78 aa, synthetic construct
KFRMFRRMYKKICPLANAVLFLKANHCLKRKAMLTSRKDLRRPLTAKGLRKKIKKQAGLRKYAKLTAKIMVLKKGDLG

SEQ ID NO: 4210 - protein, 40 aa, synthetic construct
MLRYLRKLFRRLRCNNLATMFLWPHMKKRYKRVAEFYKLA

SEQ ID NO: 4211 - protein, 42 aa, synthetic construct
RFRLITKFFKRLSTLPDAMALESSLLLATRKKRKRRLQNIMA

SEQ ID NO: 4212 - protein, 34 aa, synthetic construct
KLKMLKKWMRKWKQLAPYEVRKLLAKAQLVRKCH

SEQ ID NO: 4213 - protein, 32 aa, synthetic construct
FLKLLRKLLRKLKRAKLKLTSMPWTARTGLGL

SEQ ID NO: 4214 - protein, 52 aa, synthetic construct
RYKILRRIYKRLKKWRRLVPRLDLLKCVHKIPKAQWLLGADQKAAIAYELAK

SEQ ID NO: 4215 - protein, 48 aa, synthetic construct
IWRIMKKLYKKLNRARRAYLAQACAALLIKEAKRKKDERRLADLIFRH

SEQ ID NO: 4216 - protein, 26 aa, synthetic construct
KFKFWRRYLRYLKPWKALRNLQELAR

SEQ ID NO: 4217 - protein, 43 aa, synthetic construct
KMKLIRKLYRRLRKLAAAGKVIVDKAHRLIAQLKYRRALALTD

SEQ ID NO: 4218 - protein, 52 aa, synthetic construct
RIRMLKKWFRRYRRAATAHIDHSLLFCRRMVGQKALIKCAKLHLQARAVLLA

SEQ ID NO: 4219 - protein, 43 aa, synthetic construct
RWRLFKKIMKKLNKGASPWQLSYAQKRFERVYAAKKAAWKRLC

SEQ ID NO: 4220 - protein, 63 aa, synthetic construct
RLKFLSKLWRRLKKRIGFTEAKKDDMGAFWKKVVLLNLKLRRIQPALALALAALNATEWEKAR

SEQ ID NO: 4221 - protein, 37 aa, synthetic construct
LFKLFKRFLKFLKQKFMRPALENAQRRLKAGKALKIH

SEQ ID NO: 4222 - protein, 21 aa, synthetic construct
IIRMICKLYKLLHKRQFKRAL

SEQ ID NO: 4223 - protein, 60 aa, synthetic construct
FLKFWCRMLKKFRRKMRNLLKLMALKAKKMLAGERTVSRARHSMLKNLDLKKTREVNYKC

SEQ ID NO: 4224 - protein, 21 aa, synthetic construct
LWKMLRRYLRWLPKLAEDCKR

SEQ ID NO: 4225 - protein, 65 aa, synthetic construct
KWKWFRKWLRKFCNAPDKADYVEVLKLLLWPRNLLKTSMGRKKALKLAYALLCAMRRFPGKRKPK

SEQ ID NO: 4226 - protein, 52 aa, synthetic construct
KLKLIRRLLKFFRKKKFLGDEASACKRKGTCAIKLRLNLAAMEWRKNEGLDK

SEQ ID NO: 4227 - protein, 23 aa, synthetic construct
LLKFIKKYYKMFSNALALGDKKR

SEQ ID NO: 4228 - protein, 98 aa, synthetic construct
KIRLFRRWFKMLRRRLHLAELKLAHAHFQVNLAFTPLLARAALLFVRHKYFGLNRYALIRYLHEKALAGAKSRYFIRKNAKELARFQKWLMAARQKNA

SEQ ID NO: 4229 - protein, 21 aa, synthetic construct
RYKWFRKMLKLWSRKGAAALA

SEQ ID NO: 4230 - protein, 38 aa, synthetic construct
KLKLLKKLLKKWRKPHKLQMIALLEEWHKALAHAILGK

SEQ ID NO: 4231 - protein, 24 aa, synthetic construct
KMKLIKRFFRLFNKCKAKLQAAQI

SEQ ID NO: 4232 - protein, 28 aa, synthetic construct
MWKLFNKYFRRLKHQILLFLFGKRAALL

SEQ ID NO: 4233 - protein, 41 aa, synthetic construct
LLKLMSKYMRRWRQAKFVKLLRTVPRKGKKNYNRAAWIRAL

SEQ ID NO: 4234 - protein, 23 aa, synthetic construct
KFKMLRKLLRKYRKAYMTSAMAA

SEQ ID NO: 4235 - protein, 53 aa, synthetic construct
ILKFFKRIFRLLKTVAWAHLVRVSRLLFRLKLDHKARMAVKGKRRAKLWHALK

SEQ ID NO: 4236 - protein, 56 aa, synthetic construct
MYRFIRRLWRWWRRPRMAFAAYIRQALGRKPANRYLCIVGALKARQARKFMAKRQK

SEQ ID NO: 4237 - protein, 67 aa, synthetic construct
KLKFFRKLYKKLKTWRKLLDKLQLMRIKLMTAALKIRKLQNVKGAEGDKGRIYCYFELRLSVALKRL

SEQ ID NO: 4238 - protein, 23 aa, synthetic construct
LLRWLRKWFRRFKHQGERELLLT

SEQ ID NO: 4239 - protein, 61 aa, synthetic construct
RLKLWQRLLKKIKKKWCQDVKKGRFTNLRLKLWRIRYPKARVPSAYRLCALEKHGLLAGNF

SEQ ID NO: 4240 - protein, 41 aa, synthetic construct
RLRYISKLFKYLRRFKLSSAYALQLKYPKLMWWALKNLGKW

SEQ ID NO: 4241 - protein, 32 aa, synthetic construct
RLKIISRYLKRFRTLLKRLNLAWLKRHHRHAA

SEQ ID NO: 4242 - protein, 47 aa, synthetic construct
RLKLFRKFWKRLPKRHKFLYMAHAKNVCALQAELALAIPRLLSPCKY

SEQ ID NO: 4243 - protein, 32 aa, synthetic construct
KLRLMKRWFKLLCKSSASCAHTHFALVRRAAI

SEQ ID NO: 4244 - protein, 80 aa, synthetic construct
RFRFIKRFMKRIPKMLEGIAMFRAAAARLAAAEDAALKEAAQCRSARVPKKCCRSSKKKLAQVCLAVAKRNDTTLSSARR

SEQ ID NO: 4245 - protein, 61 aa, synthetic construct
RLKLWRRMFRKFKKYEFRQLKAANLAKPGMLFLGRVARKACARHRAFMRICFPLAAAMDHK

SEQ ID NO: 4246 - protein, 64 aa, synthetic construct
RIRYFTKLFKKMRHLCRIKGLRKGLDKKLLIAKLKKCHLLALQEDQRTTAESTSLLIYLLNAAA

SEQ ID NO: 4247 - protein, 31 aa, synthetic construct
LLRFMQRMMRYIHRVYRAQYKRRLRKLAAAG

SEQ ID NO: 4248 - protein, 22 aa, synthetic construct
RLRLFTRYYRWFKTATLLARLL

SEQ ID NO: 4249 - protein, 29 aa, synthetic construct
FLKMYHRYLKRLCRKARYSKGKQNLAEAL

SEQ ID NO: 4250 - protein, 40 aa, synthetic construct
LLRFIKKWMRRMKCTWARCPSYSAIRNAGAACLLKLELAR

SEQ ID NO: 4251 - protein, 61 aa, synthetic construct
WLKLWRKMLRWLKKKLLARRDKLKAHKMGKLMGLLLAKNIIGAQTAVKAARHKNVFAGKMS

SEQ ID NO: 4252 - protein, 30 aa, synthetic construct
KFRLMKRLIRFIPNLYLGARYLLNLLRKNF

SEQ ID NO: 4253 - protein, 67 aa, synthetic construct
RIKIMKKYLRRMKKGQLLLRRCLDAAMTRDLRPLANRLCALWKMWDQRIMTLLGHRRRAQGRRYKRA

SEQ ID NO: 4254 - protein, 34 aa, synthetic construct
LMRLFHKLFRWLRTRHKYKLDAARQADHSWKLIL

SEQ ID NO: 4255 - protein, 24 aa, synthetic construct
RYKLLNRYYKYFRKVAGKLLGCAR

SEQ ID NO: 4256 - protein, 72 aa, synthetic construct
RLKLLRRLIKRLKCGAQKLAAATRLKRKARARRMMYKLDSYEHLHCPIMRQINPKKWLYKFCEYLWSYAAKH

SEQ ID NO: 4257 - protein, 61 aa, synthetic construct
RFRLFKKLLKYWQRRLTTLKDESLGDFKREYDKLMKLRLRRLWAAKMSTKATGYKVLRAWM

SEQ ID NO: 4258 - protein, 90 aa, synthetic construct
RLRLLPKMLRLLSRGGRAILGQYKARLNGRQLKHAYLAKKHHKRCDWLMMVIMLAKIRNCKNMNRLHERMLKLSKDRRLGLRRALVIKET

SEQ ID NO: 4259 - protein, 21 aa, synthetic construct
WIKLLSKFFKFLKHYKPRKAL

SEQ ID NO: 4260 - protein, 47 aa, synthetic construct
RLRLLCRIFKIFNKLAPSLWKAADHRKQPLVKRALPYTAKRWLRAAK

SEQ ID NO: 4261 - protein, 25 aa, synthetic construct
IFRYFSRILKFFRKKANRANLAAKT

SEQ ID NO: 4262 - protein, 66 aa, synthetic construct
RLKYLRRFIRKWKKLRQYLAAGNLKRLLLYPKVNVRTKKNAASGKFTKGCFLSRLLKANNSVKWDK

SEQ ID NO: 4263 - protein, 84 aa, synthetic construct
RYRMLRKWFRLFKRKAKATLRAKKRALWGKRKNQHWRTEQSNKAAKLDQPIKPRDLNGVLARKTRREANVAKTWAASKYKANLS

SEQ ID NO: 4264 - protein, 25 aa, synthetic construct
RLRLLKRLIRKFKCLSNDLRCFSGP

SEQ ID NO: 4265 - protein, 60 aa, synthetic construct
KIRFFRKLYRFLNKRKASKDQRALEAEYRSLDKPAKRDLRISRHWPSLARFEAQCLARRV

SEQ ID NO: 4266 - protein, 28 aa, synthetic construct
KFKILRRLLKRICTFANKPFRLLREADC

SEQ ID NO: 4267 - protein, 25 aa, synthetic construct
LYRFLPKLYRRWKRAKYHFLDLLWI

SEQ ID NO: 4268 - protein, 22 aa, synthetic construct
YWRMLRKLIRLYKNAFVLSARA

SEQ ID NO: 4269 - protein, 44 aa, synthetic construct
KLKLWKRWLRKFKHAMRRGFLVLALRDVWRHPKRDSLMRAAMTR

SEQ ID NO: 4270 - protein, 97 aa, synthetic construct
RLKFFCKFFRFLKQRGRMTSAALCQVQDRFVMWRKRLMTLCLYAIKAINCGSKAHLLAALRSNLLCIRRNARARANKVQKLLLEKYWKRLLKRKGRL

SEQ ID NO: 4271 - protein, 31 aa, synthetic construct
LWRILRRMWRFLRRKPAKAIPTAAAKSHKDS

SEQ ID NO: 4272 - protein, 29 aa, synthetic construct
RLKLIPRFIKIINSFRRARALLLRFINLG

SEQ ID NO: 4273 - protein, 71 aa, synthetic construct
RFRFLNKLLKRWKRIAATRFFRKWLMLKMIAMGDAVSVVCAFKRKRKLMKKRARAALHTWGSMPALPADLK

SEQ ID NO: 4274 - protein, 40 aa, synthetic construct
RWKWFKKLMKWFPKLDTAAMKREALAMTLANASTRKYLLM

SEQ ID NO: 4275 - protein, 36 aa, synthetic construct
RMKLLHRLLRRLRPEKRGARLERSAKCRASFEAYKH

SEQ ID NO: 4276 - protein, 95 aa, synthetic construct
LFRILKRLLRKFKRGREVDIMDLMGRAWPRAWMMAYKRKVQHAYLRRFLLKLMKVKALVLNCLAEHGLEMHFLNRHHLRLKKIAKRAKRRVCHKR

SEQ ID NO: 4277 - protein, 73 aa, synthetic construct
LYKLITRFLKYYNKKRKVAWCVKRQARLRRAKRKGYGTQYKQAFAMLIYFLAEVKKKRLWRKMVLKAANPLKL

SEQ ID NO: 4278 - protein, 45 aa, synthetic construct
FLKLLSKFMKKLRSARAYVQLWNNKRPRKKAWFRAWARKKWAAKS

SEQ ID NO: 4279 - protein, 62 aa, synthetic construct
KMRLMTKLLRFMKTSLLKALRVRWRARAYWDKLLATAHRRWKSDQEIAYDRKVLGASVKGAA

SEQ ID NO: 4280 - protein, 25 aa, synthetic construct
KLRLFRKWLRRLRKYGGPLDITAKA

SEQ ID NO: 4281 - protein, 54 aa, synthetic construct
KYRLLTKLFKRLRHRLLVSIARGIWTQQKAMSRRLSLYAARIVTRIAKKAARKP

SEQ ID NO: 4282 - protein, 44 aa, synthetic construct
RMRLWRRWWRYLKRKKGLWFCRRRAMKQAALLLMRLAWHVFLYL

SEQ ID NO: 4283 - protein, 48 aa, synthetic construct
LWRYLRKLFKRLNHARFATPKLLLIPYAALDKANTRKVLRQVASTRWW

SEQ ID NO: 4284 - protein, 41 aa, synthetic construct
RLRWWKKLIKRIKKIASRAGSARQLANDGIHLDLHLFRRAR

SEQ ID NO: 4285 - protein, 45 aa, synthetic construct
RFKLICKILKLISHLGLKFGRLLRYFGAYLALKHAKTAKSALIGK

SEQ ID NO: 4286 - protein, 34 aa, synthetic construct
RLRMIRKFIRKFCQQAYHMLVLLKAKAYALWNRK

SEQ ID NO: 4287 - protein, 38 aa, synthetic construct
KFRLIKRLYKLFKHQAFLRARRIAFAIEAAAWALKKPL

SEQ ID NO: 4288 - protein, 42 aa, synthetic construct
WWKLFQRWLRWLHKQHRANRQLAIRLIALFLLARCRWRLEKD

SEQ ID NO: 4289 - protein, 22 aa, synthetic construct
KFRLYNKLYKRLPKMLARLKPL

SEQ ID NO: 4290 - protein, 68 aa, synthetic construct
FIKLLSKLLRLIKRETRAKAKKSGLDNLLPFKFKVRRSRADRARRLHIAAQLGSMITAWLEKLCAALT

SEQ ID NO: 4291 - protein, 100 aa, synthetic construct
WIKLLRKFLKMYQHDAEADEYSSVKSKKRLARFDFEYIVSSSLLKRAAKMLMARRRKCQAKLLRRYAPIKLIKKQVRAGEKLKRVLLLAWDTQAAKRPKL

SEQ ID NO: 4292 - protein, 31 aa, synthetic construct
YLRYMNRLIKLLRTLRRLMHIKLARFAYWKT

SEQ ID NO: 4293 - protein, 75 aa, synthetic construct
RFKYLKKWLKLLRKLRWEDALAHLELRWTSAPRRCAWCMLHPKARGLINKCLKKRHWPCELLHASALPYRAKYRS

SEQ ID NO: 4294 - protein, 32 aa, synthetic construct
FLRFITRIMRKLTRDLMPMALAKEAAKARVLK

SEQ ID NO: 4295 - protein, 29 aa, synthetic construct
WFRWLKRMFKRLPKQAADILKASKYLPKA

SEQ ID NO: 4296 - protein, 22 aa, synthetic construct
RLRYLCKLMRRINNLLANLLKN

SEQ ID NO: 4297 - protein, 94 aa, synthetic construct
RFRLWNKFYKKYKKKAWLLLAYFDYRKKMLLCEAYKAEQRFSDLHYKAKRKKVRCDQAAWRLIVKLRSKRLLLKGERHNKKLLKAMARLALNIR

SEQ ID NO: 4298 - protein, 67 aa, synthetic construct
KLKFWRRFFKKLRRCLDRNFKALLRKRLNLWYRNMILAACAQRARCKLLKTKQKHLATLAILHVPKK

SEQ ID NO: 4299 - protein, 28 aa, synthetic construct
KLRLFCKYYRLFRSKGTLALKCASKLKL

SEQ ID NO: 4300 - protein, 60 aa, synthetic construct
LLKLLRRFMRKIPHLHAVGARKPKYMRSAMALFIKKIGIKNFSRKKAAKAKPRKLLVGLW

SEQ ID NO: 4301 - protein, 61 aa, synthetic construct
FLRMMRKFLRFLRKNKLVRDEGRHYALKVNHWAALRIKHRAQNLLILKSRPHAKRTALLNV

SEQ ID NO: 4302 - protein, 36 aa, synthetic construct
LYRIYTKLLRLWKRLKRKKLKLKAAAKFGKFTHLAT

SEQ ID NO: 4303 - protein, 23 aa, synthetic construct
KLRLLTKLFKWLCKTADIWKCCK

SEQ ID NO: 4304 - protein, 32 aa, synthetic construct
RFRFFSRYMRLMKRHKAAILAFKLRTLHLKRH

SEQ ID NO: 4305 - protein, 37 aa, synthetic construct
FYKLLRKILRKLKQLWLQVARQRTGRVHLNRAKNMWK

SEQ ID NO: 4306 - protein, 40 aa, synthetic construct
RFKFWKKLLRLLKQMRLHTKAFRARQAGDRYPMIRGCDAR

SEQ ID NO: 4307 - protein, 38 aa, synthetic construct
MLRFIRKLFRRFCTYSRTLPVAKKAMLKHLLAKLSRVH

SEQ ID NO: 4308 - protein, 36 aa, synthetic construct
RYKILKRFLKRFRCFAQKALLANYMKLKALMISRLC

SEQ ID NO: 4309 - protein, 45 aa, synthetic construct
KLKLWKRIMKRLRPRLHAKDVPKKEVVVLWKMVLLMQLNLANRAA

SEQ ID NO: 4310 - protein, 49 aa, synthetic construct
KMRMLKRLLRKWRNVTPFFYALLRLLARHSDVLVKLGLLWVLARAKKAG

SEQ ID NO: 4311 - protein, 49 aa, synthetic construct
KLRFFPKWLKLLQTSYRLKAMRPKRLRWCIFKRKRFHKMLKSLAFMLFA

SEQ ID NO: 4312 - protein, 20 aa, synthetic construct
KLRLYKKLWRFMKPALAQTF

SEQ ID NO: 4313 - protein, 29 aa, synthetic construct
RLRLLRKILKKWRNWMNHKHRALAQANTR

SEQ ID NO: 4314 - protein, 47 aa, synthetic construct
YLKIITRLWRYLQRGMTKTRDPPVALAKLDAKTAAAEAAKARQESAK

SEQ ID NO: 4315 - protein, 21 aa, synthetic construct
YLRFYNRFLKKLRNLAKYAKA

SEQ ID NO: 4316 - protein, 28 aa, synthetic construct
RMKWYSKLLKYFRRKAAKACSIVGLAYA

SEQ ID NO: 4317 - protein, 54 aa, synthetic construct
KFKLWKKYMRLFKRIWKLLKWKDHSLHKLARKEHLAARLAAKTVQARCSAPNKK

SEQ ID NO: 4318 - protein, 57 aa, synthetic construct
KMKILKRFFRYLRRRYRYAPLACPIAACKYRLKHKPLRALDPLLIQLEKAPIAEGIK

SEQ ID NO: 4319 - protein, 27 aa, synthetic construct
RFKMITKLLRRMTKLGETVLRRLWTLL

SEQ ID NO: 4320 - protein, 96 aa, synthetic construct
RYKLMRKLLKMLKNKIWSLALCKEKNLMVGRKLLAALLALWNTHWRTKRLYPKLAWRNAMARRVRAKRHIYKNGHTKLLHLGVNCTRTYKLIAKKL

SEQ ID NO: 4321 - protein, 66 aa, synthetic construct
MFKLIKRYIRKWKKQFAILQHVRLCLRQREVLELCMAYRAWRAKRKKKKLFNRWMLKLWAKAAMLT

SEQ ID NO: 4322 - protein, 47 aa, synthetic construct
RFKLLSRLFKKLKCANLLLCALSRRKYLHVGIAYYVKLDKRAATLKF

SEQ ID NO: 4323 - protein, 34 aa, synthetic construct
YWKFMKKFFRKLCRDESALATKKRALRCRMLLSY

SEQ ID NO: 4324 - protein, 41 aa, synthetic construct
RLKYMHRLLRKWRNGLNSYALFKFRRWKRRKLYSELKFAYA

SEQ ID NO: 4325 - protein, 86 aa, synthetic construct
YIRYLKKFMRLINPPGRRSKRSELYQSAKEARRAEGYARHKRGQLNLLYRKRCALCFKRLLLVARRKKKLKMLYEVAAGAQKLKKI

SEQ ID NO: 4326 - protein, 41 aa, synthetic construct
KYRIIKKWYRKLRQASQKELLRAEACLAVVRMALGKPRLNP

SEQ ID NO: 4327 - protein, 40 aa, synthetic construct
RLRLMQRLLRKFKRKVLHALSRRPGWMLCRFEETKPALRS

SEQ ID NO: 4328 - protein, 48 aa, synthetic construct
FFKILKRLLKKFKHALKHFKRYHACECIRFCLARLYAHKAAKKSLMRK

SEQ ID NO: 4329 - protein, 38 aa, synthetic construct
LLRLWRRLFKMLRCCRYQRWIRWKDKYNRVPAKALLLQ

SEQ ID NO: 4330 - protein, 24 aa, synthetic construct
RLKILQKYLKKWRKNSASMLLLYY

SEQ ID NO: 4331 - protein, 100 aa, synthetic construct
LMRLYRRIYKLLKRLRLAMALNSLDRRLIRAKNDEDAHRRKKENDTDNKADHAIFKTRNKALNGQPCERLWPYAIAFLGLKLRCRSLLERKALQLAAMNS

SEQ ID NO: 4332 - protein, 26 aa, synthetic construct
MLKFFTKYYKLLKKARVRRNKAQHLL

SEQ ID NO: 4333 - protein, 32 aa, synthetic construct
KLRIYQRFLKKFKRLNPILRAHRLWHRGELLC

SEQ ID NO: 4334 - protein, 52 aa, synthetic construct
KLKIWSRLLKKMHKHATARVLTANVLLNLYTASLALKCPRKKPFKEMAFARQ

SEQ ID NO: 4335 - protein, 30 aa, synthetic construct
KLRFIRKFFKKWPKTKTLAYSKITLAALKL

SEQ ID NO: 4336 - protein, 39 aa, synthetic construct
YLKLWKRLLKRLSKKAKTNVFCTKAIHQLNMRLKIEKLL

SEQ ID NO: 4337 - protein, 31 aa, synthetic construct
KWKLWNRLIKRLQRRLHWALALLWRKGSKRI

SEQ ID NO: 4338 - protein, 59 aa, synthetic construct
RWRWLNKLLRRFCCRKARELLRDKLTLNALQKRLVLMPIMAMKRVSRFRRLCLKNAFAV

SEQ ID NO: 4339 - protein, 28 aa, synthetic construct
LWKMIKKLIKLLKKKRTYACLALSFIHS

SEQ ID NO: 4340 - protein, 46 aa, synthetic construct
FLKFICRLWKKWKRHSWALKCLKRAIKKWVKQLAYRPAAKEIAAKD

SEQ ID NO: 4341 - protein, 39 aa, synthetic construct
WYRILKRIMRKLKHLALAHAKMTRRRLHAELTAAVIRIN

SEQ ID NO: 4342 - protein, 69 aa, synthetic construct
LIKYFKKWLRRMRKLLIRDLKKRLLQALMIQLMRRELERNKDITEDLRAHLPAIPRSHAARAKALLLQK

SEQ ID NO: 4343 - protein, 67 aa, synthetic construct
KIRYFRKLLRRIKKLLCRKAPLAVLYMWPADTQKDILRILRALKNYRIAAKCKAGPFRHEMQARQML

SEQ ID NO: 4344 - protein, 26 aa, synthetic construct
LLKLMCRYYKLLHRRERLLCKKLWHR

SEQ ID NO: 4345 - protein, 28 aa, synthetic construct
LIKLLSRLFKYIHKSQNLAHKLLLRKKV

SEQ ID NO: 4346 - protein, 26 aa, synthetic construct
MFKLYNKLFRKLRKELQALPQNARLE

SEQ ID NO: 4347 - protein, 80 aa, synthetic construct
KLKWLRKWLKRLNRDMPTPTWMALKTAKKKLAARKHNHKIRHWILTGLTCYEHLQKKLKTRWAIMLNARAGARKRMKVDA

SEQ ID NO: 4348 - protein, 43 aa, synthetic construct
YWRLMSRMMKILRKTEPAMIRLAKRAKIKIFMAAKRSMRLAAI

SEQ ID NO: 4349 - protein, 34 aa, synthetic construct
KYRFIHRLYRRFKTAIRLMKARKYTCAKALATYA

SEQ ID NO: 4350 - protein, 35 aa, synthetic construct
KFRLLNRYLRKLKRRLKPCKHHLKAALCHHVKKVA

SEQ ID NO: 4351 - protein, 71 aa, synthetic construct
LLKLMCRLLKLLTPLAYCAMLLGKCTRANRYLLTLLRRAWARREWRATLRKKKKIKECIRRKNCHANKALR

SEQ ID NO: 4352 - protein, 25 aa, synthetic construct
YMKFYRRYLRKLSTEDKLCRAAWKA

SEQ ID NO: 4353 - protein, 55 aa, synthetic construct
WYKMLCKFFRRFQKWDKALALRKYKRRLKENAHNLELKRALARRGLQMTYDAHYL

SEQ ID NO: 4354 - protein, 65 aa, synthetic construct
KMKLLRKLLRLLKQRDLWLKPIELRNYRLKKIRQKLRQMGKSEVCKCIIGLSLAEKPLKHYQMLL

SEQ ID NO: 4355 - protein, 32 aa, synthetic construct
RYKLLRRFIRLLPKVDYCRAILKHQGFRLANK

SEQ ID NO: 4356 - protein, 70 aa, synthetic construct
MLRFIKRFIKKLHNSRLWRLTLNNLYAMKWLLARRQCTKLICAFPRCGAKRQRPCARTRNKIARRPAARR

SEQ ID NO: 4357 - protein, 40 aa, synthetic construct
YLKFYRRFMKLLRCGVAELRKRRFARNARARLRLMLWLLK

SEQ ID NO: 4358 - protein, 26 aa, synthetic construct
KFRLLNKYIRRFRTEILKAKLAYMAT

SEQ ID NO: 4359 - protein, 22 aa, synthetic construct
LLKLLRKIFRRFRKRHGEEALM

SEQ ID NO: 4360 - protein, 49 aa, synthetic construct
LIRFFQKILKRLCRRYMKKKILARLRKGNTAAAIMKHDAAKKKELECWS

SEQ ID NO: 4361 - protein, 30 aa, synthetic construct
RLRFWTRFIKRFRSKLAAWRLKRGLMAANH

SEQ ID NO: 4362 - protein, 20 aa, synthetic construct
LFRLMSKWIRILRRSELKAF

SEQ ID NO: 4363 - protein, 38 aa, synthetic construct
RLKWLKRLFKRIRRRLNSGLTNLQKRAAVLRAGQYILW

SEQ ID NO: 4364 - protein, 25 aa, synthetic construct
KWRILKKYLRMFRKTALKMIAKLYA

SEQ ID NO: 4365 - protein, 58 aa, synthetic construct
MLKMFKRLWRRIKTMLARWRLKYKCLKARMKLYLKLVRHKVWAANAYAELECNLASGA

SEQ ID NO: 4366 - protein, 52 aa, synthetic construct
RLRYFNKWWRLFKKFLVRRDLRATSHLVEANELAKVRKTARKKENAARDHAW

SEQ ID NO: 4367 - protein, 40 aa, synthetic construct
KFRLLKRLLKRWKRLLLYKANKIKCGDKVPMNLWMKMFAR

SEQ ID NO: 4368 - protein, 58 aa, synthetic construct
YFKWFQRLFKRLKCAMKDRRIKRLKLKTHYRLMSARRLGDAMKSCLEARLFAAEFRPK

SEQ ID NO: 4369 - protein, 42 aa, synthetic construct
RYKLFCKLWKFMRRWNACAAKKDTEIGAKRAARIRGATAKLQ

SEQ ID NO: 4370 - protein, 21 aa, synthetic construct
FWRLLNKMIKKFKPLREAVKA

SEQ ID NO: 4371 - protein, 33 aa, synthetic construct
LFRFLQKMLRRYHQERHLVEVKAKKAFCALRAR

SEQ ID NO: 4372 - protein, 33 aa, synthetic construct
RWKLLPKLIKRLRRAKAATKALHHAKNRRMHII

SEQ ID NO: 4373 - protein, 32 aa, synthetic construct
ILKFLKRMLRRFQKQSEVVEEKHLLAKLLKVL

SEQ ID NO: 4374 - protein, 91 aa, synthetic construct
RYRFWKKLIRFLKRLLAFRTRARLRKATATLLPRKRLKADLRAALRMTTPRLSSQKQAEFKTETCCSARATKKDRLKIRRALMCLARLRPW

SEQ ID NO: 4375 - protein, 27 aa, synthetic construct
KLKFIRRLWKKWKTLARLYLACTYRNC

SEQ ID NO: 4376 - protein, 49 aa, synthetic construct
LLKLLQKWWKRWCCEDKKALVLLAFVCAQKAKRMFHNRRRLENESANAL

SEQ ID NO: 4377 - protein, 28 aa, synthetic construct
RFRWFCRIMRRFRRALKCAALALRLIEL

SEQ ID NO: 4378 - protein, 23 aa, synthetic construct
RFKFLKKLFRLLTRKQYLAKRFA

SEQ ID NO: 4379 - protein, 37 aa, synthetic construct
RMRWLNKIFKRIKKHRFCLRSHLFLLRAKLAALMDEM

SEQ ID NO: 4380 - protein, 24 aa, synthetic construct
KFKLMNRILKILKKELMSDGRLLK

SEQ ID NO: 4381 - protein, 82 aa, synthetic construct
FLKLLPRWFRKYNRARYLKRRCWLALHLLRPSRLDLDLGVHACFKLVKLPGAKKPKARKTPKLHSAGKLRYRSHQQARMRYK

SEQ ID NO: 4382 - protein, 33 aa, synthetic construct
KMRMLRKLYKKWKHRLHLRKALAMHHALHKTAA

SEQ ID NO: 4383 - protein, 30 aa, synthetic construct
WWKIYRRLLRLIRRAQKGKAKRRETEADAA

SEQ ID NO: 4384 - protein, 58 aa, synthetic construct
RLRWIRRLMRRWSNFLLRKLLILGIYPEALVSTHTWARALKARNRVRFRKEALDLCAK

SEQ ID NO: 4385 - protein, 34 aa, synthetic construct
MIRWMRKLMKKLRKWKSYAKLLRKSLLRAANLPG

SEQ ID NO: 4386 - protein, 56 aa, synthetic construct
WMKWIKKLIKRLTRKKLTQKQLFLPHKAALFFKKDWTRPRATDRAKFAAGLAMYIR

SEQ ID NO: 4387 - protein, 40 aa, synthetic construct
KFRLITKLLRKWRKLRNRDSLALSKRLSTRMAKKFPTWIA

SEQ ID NO: 4388 - protein, 83 aa, synthetic construct
LLRLISRLWRRLSNWHQVHEREALGRKLAEADFPLLKAERSLKDALLKALLGKLAQKKASAAWAKSRAAPVAKTKTRIMRSRH

SEQ ID NO: 4389 - protein, 63 aa, synthetic construct
KIRLYRRFLRKWKHIGAMKAEARIMYELRKFLMCKKLIARAKQAAYRSLWKLTAWSRVRKWYV

SEQ ID NO: 4390 - protein, 20 aa, synthetic construct
LLKWFCKLLKFLRNPRYCKL

SEQ ID NO: 4391 - protein, 43 aa, synthetic construct
LWRLFPKYFRRMRPTLALKLIEKRRPHSALEAANAPNTLRSKL

SEQ ID NO: 4392 - protein, 54 aa, synthetic construct
RFKLFKRLFRRIRTKAAFQRMQKRAYPLPCLRSAAFLLNACWRDIAVLKLGRAE

SEQ ID NO: 4393 - protein, 34 aa, synthetic construct
IFRFLCKLLRLYQRKQCALRLLFKKRTWKQYMIR

SEQ ID NO: 4394 - protein, 89 aa, synthetic construct
RWKLLCKLLRRMRRKDQHRVRYFENAGLMLRKGKDYKEIARGVSLRLRALAMALPRRSELWDARRRPWLSITLRLSALMKYARKYTLNW

SEQ ID NO: 4395 - protein, 50 aa, synthetic construct
LYRYYKRLIRKLNKLEVAERLLKRELCRTLFFKLRRHHAGCKKDHGKAEC

SEQ ID NO: 4396 - protein, 22 aa, synthetic construct
RLRILNRYLRWYKRLIDAFMLA

SEQ ID NO: 4397 - protein, 97 aa, synthetic construct
YIKLLKRFLKRIKKRDCNRLNQGLNHRMQMTKLIKLAVLWKLFKAVALRRYRSRDRLCCLKHLNAKFITRKLAKRLSFRRQNLLTDCAKMAKFKKPA

SEQ ID NO: 4398 - protein, 51 aa, synthetic construct
ILKWFRRFLRRWRRRNRGMAAAAKNYFLQNKKDKRLLFSLDLVLGFALKTG

SEQ ID NO: 4399 - protein, 30 aa, synthetic construct
FLKLLKRLLKIYHKKRFCANCKHQAVGLAY

SEQ ID NO: 4400 - protein, 45 aa, synthetic construct
RLKWLRKMLRKWCKIRKVVDEKKRYLVKFCKLALRAAWLTAMSDW

SEQ ID NO: 4401 - protein, 32 aa, synthetic construct
KLRWLRRLWKRLKRRIIVDAAARSKQFQASGQ

SEQ ID NO: 4402 - protein, 77 aa, synthetic construct
RWKLIHKMLKKFKHLLFRLKRLERRKKQNATFFYDPHCACWAKARESLAARKHDKNQLFYRKDMARRWLRLREMLRQ

SEQ ID NO: 4403 - protein, 44 aa, synthetic construct
MFKWFKKLLKLMCRIKLLQIERRQTRVFDGLKFLKLRRKAALDG

SEQ ID NO: 4404 - protein, 40 aa, synthetic construct
LMKFLCRLLRRFKSYIMKHTLRLWRKRLQSITKLCNNLKA

SEQ ID NO: 4405 - protein, 22 aa, synthetic construct
LIKMWRKWLKRMPKLAEPRLWA

SEQ ID NO: 4406 - protein, 66 aa, synthetic construct
KYRMLCRLLKRWNRIEMKAARLGADIMKRALKNTADQSEWKAAFGAFKKALAAQKALKAAKSFCPA

SEQ ID NO: 4407 - protein, 46 aa, synthetic construct
LFKFLNKWMKRFKKLKARFSWYLAQLAAGDAALSRYLRFVRRTAML

SEQ ID NO: 4408 - protein, 39 aa, synthetic construct
LYKLLKRLWRKLQRYFHRNMLADDAEFSKTRKLGLSARK

SEQ ID NO: 4409 - protein, 40 aa, synthetic construct
KLKFLTKWLKYWKTAKWAQARFRDNLRANRLRVLFAARFL

SEQ ID NO: 4410 - protein, 21 aa, synthetic construct
RIKLWRKFLRKFKSSMLLSLQ

SEQ ID NO: 4411 - protein, 33 aa, synthetic construct
RLKFYRRLYKMYRKQAGRRGHRWRLLQFFLVAL

SEQ ID NO: 4412 - protein, 21 aa, synthetic construct
RLKMFQRLMRKLNKCKFHHLL

SEQ ID NO: 4413 - protein, 98 aa, synthetic construct
LMKLLKKLLKRWQNKANLAFAFDATGQKLLKALRWNKQRHHGRDRARTRKRAALRKRRTTNQQKAFHAYRMDFWDSLTAGEMLRLRRLAHQLGKNTAM

SEQ ID NO: 4414 - protein, 20 aa, synthetic construct
RLKLWNKMIKRLKQSWAAWC

SEQ ID NO: 4415 - protein, 40 aa, synthetic construct
YIKLYCRMFKRIRRCASTGALNAYKLRFVQHKAHLLLKLK

SEQ ID NO: 4416 - protein, 58 aa, synthetic construct
RLKYYKRLIKIFHKNKSFRGGTMRWYKCRRALELLLWKLKAMARRLAAHVAAPLGIAP

SEQ ID NO: 4417 - protein, 25 aa, synthetic construct
LLKFLCKLFKWLHCKLRVNKQLVKR

SEQ ID NO: 4418 - protein, 36 aa, synthetic construct
LLRLWRRLLKKYKHLDMFQWAKCRKLKTWAHAGIFI

SEQ ID NO: 4419 - protein, 35 aa, synthetic construct
LFRLMKRFLRIFRQLGGHKQAHALWRRDLARAKMA

SEQ ID NO: 4420 - protein, 54 aa, synthetic construct
KFKLFSRLFRKFKSYRRGKYDRPAVDSAMLARLLARLKKNVKGARLTERPTGEA

SEQ ID NO: 4421 - protein, 20 aa, synthetic construct
WYRMLPKILKLLRHLRDLAF

SEQ ID NO: 4422 - protein, 46 aa, synthetic construct
RFKYFRKLLRRLTKMDMAWVKLWLLLSWKRELCLLKWLEAKQTAKI

SEQ ID NO: 4423 - protein, 25 aa, synthetic construct
ILRLYCRLLKIMKRWDLKAKLSVIK

SEQ ID NO: 4424 - protein, 84 aa, synthetic construct
KLRFYRKLLRKMCQKCWKRERKSAEKLLAAMRAKRRAAACNKRARAMSNNQLEANQRFRAKTVECPRTLALLKLNPARRALRDA

SEQ ID NO: 4425 - protein, 27 aa, synthetic construct
RLRFWTKMLRKLRKLKLASAAALRRFK

SEQ ID NO: 4426 - protein, 59 aa, synthetic construct
RWRLMRRFFRLYKKLINKRVLPCLPAKATAREPARCSLAMEDIRNVKKLEAWALLGMKR

SEQ ID NO: 4427 - protein, 48 aa, synthetic construct
KFKFLCKFFKKLQKAEEAHRVVPLQALTRARSLAKCACLYRLLKSKKQ

SEQ ID NO: 4428 - protein, 29 aa, synthetic construct
LLKLLRKWLRKLRRRAGAPSHPMVAQVIK

SEQ ID NO: 4429 - protein, 36 aa, synthetic construct
MMKMWKKLFRILKRCKPLLKLHWNLERAADWRRLES

SEQ ID NO: 4430 - protein, 31 aa, synthetic construct
RYKFLHRMFKLLNRANIKLRWMLERKRAACA

SEQ ID NO: 4431 - protein, 21 aa, synthetic construct
RYKFFQKLLKRFRPHYLLDKA

SEQ ID NO: 4432 - protein, 37 aa, synthetic construct
RLRFFKRIYKFFRKLLWPDLCTDALGLLALQRHLRML

SEQ ID NO: 4433 - protein, 29 aa, synthetic construct
LLKFWRKLMKYMRRAVLPAALQKCKTAKT

SEQ ID NO: 4434 - protein, 23 aa, synthetic construct
LFKLLRRLIRKFKRRASKLALRA

SEQ ID NO: 4435 - protein, 20 aa, synthetic construct
YLRLFRRFYKRLSSTSLLER

SEQ ID NO: 4436 - protein, 41 aa, synthetic construct
LLRIYKKFLRFLNKALKRYPLKHRWKIACWNLRFASRLKFL

SEQ ID NO: 4437 - protein, 74 aa, synthetic construct
KMRWIKRLLRRLQRIPLLLALAKLFACDEADAPKLFVRMNRVYKYDYNRSLLLPVRRTRARARLFPKRHFLIAR

SEQ ID NO: 4438 - protein, 29 aa, synthetic construct
FLKMWHKLIRFLKKFAMKKNSAKLTELGR

SEQ ID NO: 4439 - protein, 30 aa, synthetic construct
FLRLYRRFIRRFHSRLLLHKDLRWKLLPRI

SEQ ID NO: 4440 - protein, 50 aa, synthetic construct
WLRLMTKLYKMFRQMSALKNAKRRALKVDKPARLSKALKRWSVNARGLNR

SEQ ID NO: 4441 - protein, 73 aa, synthetic construct
KLKWIRRYFKLFQKMKAKSKPCKMDRPAAQHCRVTLQLHARRRLLQMEKRKRLKVMDAAHFAERRDTAAYLLK

SEQ ID NO: 4442 - protein, 20 aa, synthetic construct
RIRMFNRWLRRLKHYLAKLY

SEQ ID NO: 4443 - protein, 81 aa, synthetic construct
FLKMLRKMLRKYRQPLKRGHKRAAKKKNTLKLYAISMAWAMKRRIKLLCWAISAKPGDWKRRAYRLNAAQKAPDAVQEKRH

SEQ ID NO: 4444 - protein, 86 aa, synthetic construct
KYRFLQKFLKILRPLKFIPAANLRSAQRCYRLCMIDAAEKNRAIGLHPKHAAMCHLRRFKRRPALLEMARRSRFINKKRLLLAKRH

SEQ ID NO: 4445 - protein, 64 aa, synthetic construct
RFKILKRLLRLLHPNKATLKARATMQRKEKYYSLELAWHKAPDAKMRVLRVLLKMLSEKAAALA

SEQ ID NO: 4446 - protein, 20 aa, synthetic construct
KLKLLHRMYRKFCKAVWLKQ

SEQ ID NO: 4447 - protein, 100 aa, synthetic construct
YIRLLCRLMKLLCCERKAISEDSVLKANLRLYLRLPSLELLLKKNWNKAPRADKALMRLENMLIFCIDRQLAFCKLRVQRGKMKMAKKRLAQAATTGPKA

SEQ ID NO: 4448 - protein, 21 aa, synthetic construct
RYKMLCRLLKRLNRLLFTKPK

SEQ ID NO: 4449 - protein, 25 aa, synthetic construct
RWRYLKRYLKLLPKAKAKRLWDADN

SEQ ID NO: 4450 - protein, 63 aa, synthetic construct
KFKFMHKLLRYLHKDPPLAKYFDNPAAALRKARITCKRRAWKKAARAYQEMAIARAWRWLTHF

SEQ ID NO: 4451 - protein, 43 aa, synthetic construct
YLKLFQKFFRFYRRKLLKRSALYLNLLALLRCKLLCKHDPQMR

SEQ ID NO: 4452 - protein, 44 aa, synthetic construct
KLKMYCRWWKLIKNALRRVAWAALLDAKKTKQAHKHFKVWLKLY

SEQ ID NO: 4453 - protein, 45 aa, synthetic construct
LLRIIKRLMRMWPSKKRWLAAAYKFLMCAVKRMLLPSDRAEAADS

SEQ ID NO: 4454 - protein, 58 aa, synthetic construct
FLKLLTKWFKRFSKILKRLLLVKFGDTRDAQLRNAAKTMNKARFRTCLASPRRKEHKR

SEQ ID NO: 4455 - protein, 35 aa, synthetic construct
KLKILKRLLKLLRNLKVNKPALMQLRGHEAKRRCP

SEQ ID NO: 4456 - protein, 36 aa, synthetic construct
KIRLITRFMKKLHKAWLDIKGAVARKGAKGHLKLLW

SEQ ID NO: 4457 - protein, 26 aa, synthetic construct
FWKYLRRLFRFLKKRLILKTAKSAGS

SEQ ID NO: 4458 - protein, 26 aa, synthetic construct
RLRILNRFIRKIRKKLALGKLSICLL

SEQ ID NO: 4459 - protein, 45 aa, synthetic construct
RFKLLKRILRLLQRKLLCAPDFIATKASDIIAKAKGHKPRCWQRF

SEQ ID NO: 4460 - protein, 62 aa, synthetic construct
RLKYMKRLMKKFKRKLASKLLHARGLIRNAVFTRRAEMAIANGDNLCFRRKMLRQAHKTMAG

SEQ ID NO: 4461 - protein, 66 aa, synthetic construct
FIRLLHRIWRRFKRLDTKYAALNSRDKKACLLLDYRFALAARYSRPLYHQRAKKRNNNATAIKQRL

SEQ ID NO: 4462 - protein, 31 aa, synthetic construct
WLKLLRRLFRRMNKPMQRAAGKDPSKWAKYA

SEQ ID NO: 4463 - protein, 36 aa, synthetic construct
RFRIFHRLFKRLKCLLLAKLNQLILIDKAVYKEEHK

SEQ ID NO: 4464 - protein, 27 aa, synthetic construct
RIRWFCKLLRLLRKALPHYLNKVAGRR

SEQ ID NO: 4465 - protein, 76 aa, synthetic construct
LWKLYHRFFRKLRPDKRPRIFKAAAAVTPTLLLYWACKDAKKKKACDLTRRSAKKGLKLYRWTAVMRLGPASGLLG

SEQ ID NO: 4466 - protein, 49 aa, synthetic construct
KLRILNKFMRLYRRGCVDLKLLWWRKLEKLQVKLAATTLKHDAFALRSL

SEQ ID NO: 4467 - protein, 32 aa, synthetic construct
FFRFFKRLLRRMKKVDYWLVRAALLIYDLSRL

SEQ ID NO: 4468 - protein, 24 aa, synthetic construct
IFKYLKKFFRLLKKADVAKQAIMR

SEQ ID NO: 4469 - protein, 50 aa, synthetic construct
LFRYLKRLLRRLPKCNYMPAKRANFRALLLARCAYVEKPKAKRAIKNYKL

SEQ ID NO: 4470 - protein, 33 aa, synthetic construct
KFKLLRKMLRRLTCLILGIPWIKKCMCKALRTL

SEQ ID NO: 4471 - protein, 22 aa, synthetic construct
YMRMFKRYLKKLHKALNLRAAN

SEQ ID NO: 4472 - protein, 43 aa, synthetic construct
KWKLLKKLMRLMRRVEAESLAANAEWPWVLKGRWRDALFLFCL

SEQ ID NO: 4473 - protein, 37 aa, synthetic construct
YFKLLKRYLKRLCHAKKNKRAMKTKQLGSTSLSMELK

SEQ ID NO: 4474 - protein, 37 aa, synthetic construct
MLRLMSKFWRRLKPALKYYARLYLRLKLKLSFRKRMW

SEQ ID NO: 4475 - protein, 42 aa, synthetic construct
YWRLYPRILRRYRHRMKHKKGRAHVKAVQARALANAELFLLI

SEQ ID NO: 4476 - protein, 36 aa, synthetic construct
RFKFWKKLYKLYKKQRLMFWKKLYLSTLASCKAQLQ

SEQ ID NO: 4477 - protein, 61 aa, synthetic construct
KFRFIKKLMRKFRHLTLHKAGKRATGKAIGKRYCARSLRRLGAFLQQLKLNRVTKQCRWCA

SEQ ID NO: 4478 - protein, 52 aa, synthetic construct
KYRMLCKYMRRIPKALNRARRLMNLDHQNAQNRAKKLMDCKGKLHKASLRQK

SEQ ID NO: 4479 - protein, 25 aa, synthetic construct
WIKILKRLLKFFRRWKAMCTIAIAK

SEQ ID NO: 4480 - protein, 73 aa, synthetic construct
LWRLFSRFLRLYHSNKALIKACELLKGKRNARYDSKLWWLKNSAVLKRKIPLECKKLAYLAHSKLKHLLPSQL

SEQ ID NO: 4481 - protein, 44 aa, synthetic construct
RFRLIPRLIKKMQRTYMKSMRLAKYDAPLNLAKLAAKRKEILFY

SEQ ID NO: 4482 - protein, 92 aa, synthetic construct
KIRLLHRFWKKFKRLIKKNNEGLAKLMACTLLCLAAKKRLKAWKRKSGRCRARNVALMKEFMALWRACDTKDVYSRKSKLENVSRLVKHARR

SEQ ID NO: 4483 - protein, 25 aa, synthetic construct
KMKMIRRFLRKLRKAALELATLEAV

SEQ ID NO: 4484 - protein, 41 aa, synthetic construct
KMRLLRKFIKFFKHARTAAGWAQSKLYSAATPYKKRASCAR

SEQ ID NO: 4485 - protein, 30 aa, synthetic construct
RIKLLKRLWRYFRRHAESAAPKKNQFRDCA

SEQ ID NO: 4486 - protein, 64 aa, synthetic construct
LIRYLKKLFRLMKKTYRKAVGWINAAAYRRDQQKALKLDTDAVCGLGSKAQRAIKRTRMRKLPK

SEQ ID NO: 4487 - protein, 35 aa, synthetic construct
RFKLYTKMLRLLHQKKRRRHSQYLQRHRAAAALIT

SEQ ID NO: 4488 - protein, 53 aa, synthetic construct
KWKFWKRYFRYLKRKLELCIVCYVALKAPLDMRRLRLLMRLRGRHFLSRMAIK

SEQ ID NO: 4489 - protein, 61 aa, synthetic construct
RMKLYRRLYKRYCKKLRRARALAKLLRGMSGKAKAWMGDWRWTKRATAVRKYIFSEMAPFN

SEQ ID NO: 4490 - protein, 40 aa, synthetic construct
YFKLMKKFIRLLRSRLTPCKKPYLLAAAGKRKLCAALPRR

SEQ ID NO: 4491 - protein, 22 aa, synthetic construct
FLKLMRKMLRKFPNLRDKLVQA

SEQ ID NO: 4492 - protein, 32 aa, synthetic construct
YLRILRRLLKFFQKQGRARPRLVLLKYNRIAT

SEQ ID NO: 4493 - protein, 24 aa, synthetic construct
LWKWLKKMLKKFSNDFALKKKAGH

SEQ ID NO: 4494 - protein, 79 aa, synthetic construct
LLRLLQRFYKRMKQLRLKLRALKPDNAKTLAEETKWIWDALRRASALRWFKTGLLYGFKAAGTKLFKFKNLPLDMARVA

SEQ ID NO: 4495 - protein, 37 aa, synthetic construct
LLKILTRWLKKLCCAMAAASARTKWPMVIQRNAFRKK

SEQ ID NO: 4496 - protein, 29 aa, synthetic construct
LIRWLNKFLKIWKRSAAAKGAGDKAYQAC

SEQ ID NO: 4497 - protein, 40 aa, synthetic construct
MLRWMHKLLKRLKKWIMAGKRHRELHAKAYLRLYWIKQRR

SEQ ID NO: 4498 - protein, 85 aa, synthetic construct
MLRIIRRLLRFLSKRIYLNQAHWAKHKAVTHDKACLYMEKAKMKLPLERMWLRLQRAAASKLKRDMNRAKACALRRRWLRRSSMW

SEQ ID NO: 4499 - protein, 21 aa, synthetic construct
KMRWLRRFYKLYNKALATDLM

SEQ ID NO: 4500 - protein, 45 aa, synthetic construct
LFRLLRKILRMLRCWKAKATVRLLDHLTQQRGLRKSTVSFLGREL

SEQ ID NO: 4501 - protein, 30 aa, synthetic construct
KFKLLRKMWKLLNKRRRAHRIAGARQNNAG

SEQ ID NO: 4502 - protein, 36 aa, synthetic construct
RFRWWKKLFKRMSTAPRLFQSKKALALALQKKRKAY

SEQ ID NO: 4503 - protein, 56 aa, synthetic construct
KIRLWRRMFKLLQSGFRALNKFAAKAAHLLQLPRPKRVMRHEVKTLKYAKRALKPE

SEQ ID NO: 4504 - protein, 23 aa, synthetic construct
KLKLFRRWWKRLSSLAHQRDEFA

SEQ ID NO: 4505 - protein, 43 aa, synthetic construct
IIRMLRRLFKMWRCPNAALHEHTRTLCACRRVALARRWARLLR

SEQ ID NO: 4506 - protein, 39 aa, synthetic construct
YLRFLQKFYRRWTTRGAGKKVIKAALKAYRRLARKCAVS

SEQ ID NO: 4507 - protein, 30 aa, synthetic construct
FLKWLKKLMRYLKKKIKHKARNGLADKAYH

SEQ ID NO: 4508 - protein, 20 aa, synthetic construct
RLRLMNKLFKKLHSDWEFLK

SEQ ID NO: 4509 - protein, 47 aa, synthetic construct
KMRFLKRYYRLLKRRSRNNKLALALHFPDDIYNSLAHRTALFHAAAH

SEQ ID NO: 4510 - protein, 33 aa, synthetic construct
RWRLYPKFLKMLTKLLKMLKALFLRLHPIPQWR

SEQ ID NO: 4511 - protein, 22 aa, synthetic construct
RLRFFTRLWRKLPHLQLARWLK

SEQ ID NO: 4512 - protein, 52 aa, synthetic construct
KLRFFNRFFKRLPRLIKWAAHRLMIKLKKLGQKPARTIHCKKWAMGLAAKQP

SEQ ID NO: 4513 - protein, 24 aa, synthetic construct
LIRLFKRLMRRLRNLLFLKNSTQE

SEQ ID NO: 4514 - protein, 60 aa, synthetic construct
KLRLLHKFFKRFSKCANKPLARYKFQRLRHSLKALRNQVLCLCHAVAMAKQTKAAKAEKK

SEQ ID NO: 4515 - protein, 28 aa, synthetic construct
LLRYICKYLKLIRSNAKKRAKKAPTMAR

SEQ ID NO: 4516 - protein, 54 aa, synthetic construct
FLRYLRKYFKLFKRAGRHRMLQLALSLEPLRIIRDAKQAAQKKPPALGYTSKAL

SEQ ID NO: 4517 - protein, 47 aa, synthetic construct
RIKLLRRFFRFLRKAHCAFSMTLRAAKQRCKWAMLKFRGILLFGVRL

SEQ ID NO: 4518 - protein, 36 aa, synthetic construct
KLRLMRRLLKLLTRFRIFRPPLAAKCKSQGLKMFMP

SEQ ID NO: 4519 - protein, 32 aa, synthetic construct
RLKLYRRLYRLFRPGGFARAAATAQDVRTPAP

SEQ ID NO: 4520 - protein, 29 aa, synthetic construct
FMRWWTRLLKKIRNEAAAKGARMHIWAAL

SEQ ID NO: 4521 - protein, 46 aa, synthetic construct
LWKLLNRWLKRLTQEGLKAPFWRLALKVKSWEAQLALRPRRDKAKK

SEQ ID NO: 4522 - protein, 40 aa, synthetic construct
KYRLYRKFFRLLRQRALNQETSPALYEKLLDRKRAKKYRP

SEQ ID NO: 4523 - protein, 24 aa, synthetic construct
LFKYYNKLWKRMRKIARLGGLRLT

SEQ ID NO: 4524 - protein, 36 aa, synthetic construct
KLRLLRRILRKFNKRRARLHHSKDLWLLVCQEYREI

SEQ ID NO: 4525 - protein, 23 aa, synthetic construct
FFRLMKKFLKKYRRALNYAQMAA

SEQ ID NO: 4526 - protein, 60 aa, synthetic construct
KLKIFPKFIRMWKPKCACEKLALKKCYKVNRWAARICKLPMLEKRLARKLLERRRVVNLD

SEQ ID NO: 4527 - protein, 57 aa, synthetic construct
YYRLWTRMLRLLRSAIFKAKFAWRWAAETIFRRCISRKCRKVLLLAAKDSKYARAIR

SEQ ID NO: 4528 - protein, 44 aa, synthetic construct
LWRFYHKLIRLLRRSAYRALRKLRSWYQARAQRRRWSIARNIAY

SEQ ID NO: 4529 - protein, 78 aa, synthetic construct
LMKLLRRLWRFMNNLLAFTAKKLAIEYWRMQPCSFQLECFLEMAENPKLRRDRLYRLKLADARLRRRKKRNKRLLAAH

SEQ ID NO: 4530 - protein, 48 aa, synthetic construct
RLKMLKKMLKKLTRRMQAIAKAAKLLLCHRELEAASKPKHPFAYAEAT

SEQ ID NO: 4531 - protein, 52 aa, synthetic construct
LFRLISKLWRKMCKACAPEFLKKKPLRHWSLAYWLRLKKERSSATRLMAKYV

SEQ ID NO: 4532 - protein, 22 aa, synthetic construct
MLKLLRRYWKKFCREARLAFAM

SEQ ID NO: 4533 - protein, 33 aa, synthetic construct
LYRLFCRLMRLFRPFDELKKRELPTKLYRCRAR

SEQ ID NO: 4534 - protein, 80 aa, synthetic construct
FYRLIKKMWKLFRKGTKAMAVLMYYYRLTSLLAAARHKGVLWLKSKLQKNIHKRTKTKCIAAAKVRQAAMMNAADKLRIL

SEQ ID NO: 4535 - protein, 24 aa, synthetic construct
LMRLLKRLWRLIRCPAMRRKDANY

SEQ ID NO: 4536 - protein, 55 aa, synthetic construct
RLRLWRRFLKFLKHDDRIIAAKRRLLLKLKLRLWSVHHKPLPRRDILREHMVAPP

SEQ ID NO: 4537 - protein, 55 aa, synthetic construct
LFRLLKKIMKLLRNAWSKSILYAVLTIMRCKLTKGALIRLAKRCLKLRLIRKQKD

SEQ ID NO: 4538 - protein, 60 aa, synthetic construct
YLKIIRKYIKRIHRQERVKLRHEKNMQLKARNADHFSLSKAQALDLATRSLKKKIWLRKL

SEQ ID NO: 4539 - protein, 57 aa, synthetic construct
KLRMLSKLFRKFCRCILWALLRKYARGKYSLKYLNVSLKETRRPKETLDLRQACYKL

SEQ ID NO: 4540 - protein, 42 aa, synthetic construct
WIKILNRIFRRLRKRNFQFLRLDELLAQLKKATYKGSLAAAG

SEQ ID NO: 4541 - protein, 30 aa, synthetic construct
RYRILHKFFKFLKKKRNAGLGRLDKPAAFG

SEQ ID NO: 4542 - protein, 26 aa, synthetic construct
KFKLFKKWLRLLQNARMNKWRVALKW

SEQ ID NO: 4543 - protein, 52 aa, synthetic construct
KFRFFKRLWRKLKSKLKKRAAAWRQTVFMELAKRPEAAARFSGMARARLAGA

SEQ ID NO: 4544 - protein, 50 aa, synthetic construct
KFRIFHKLLRKWCKLLKARWQSRRTAVLLWLPYDKTCLYLKARHALFYHA

SEQ ID NO: 4545 - protein, 92 aa, synthetic construct
LLRLFRKLWRKLKRNHYRIKLGDKKTACRWLCRRTAAFLNRINLVLLRRQRKLKARARLAPRDISCVDAGCRIMKAAMIKCMGAGRAIDLVG

SEQ ID NO: 4546 - protein, 48 aa, synthetic construct
FMRLIRKFLRKLQCKAEKLAALHWFKKRIKKAADRLAENKSDAWVGLQ

SEQ ID NO: 4547 - protein, 41 aa, synthetic construct
KMRIMKRLLKFLKKRQPLLRRKAFLTHAHPHARDKLKCPLK

SEQ ID NO: 4548 - protein, 51 aa, synthetic construct
RWKLYRRFLKRLNRYRAYWRAVMSQRATFRRLRYLAKEMARMFQKLLIMLR

SEQ ID NO: 4549 - protein, 24 aa, synthetic construct
WWRFIKKFLKKLNRLLRAKSWMAA

SEQ ID NO: 4550 - protein, 42 aa, synthetic construct
KMRIMKRFFKRIRKLMGAGLQKFLRARLLLDLLRKAFYAQLL

SEQ ID NO: 4551 - protein, 24 aa, synthetic construct
RMKIFRKLLKKFNRAPLKAELCSA

SEQ ID NO: 4552 - protein, 48 aa, synthetic construct
RLKLYRRFLKRLRSKRWANLARADLFKKVHWHQKRAAQQPYKKLMSMD

SEQ ID NO: 4553 - protein, 23 aa, synthetic construct
RYKLLRKLLRKYKKIKLMPNQLA

SEQ ID NO: 4554 - protein, 60 aa, synthetic construct
KMRFWKKMLKMLRKLGAPRNQLDAARLRRTIKARTKIAAPSLHQAPGRLLAAFALFHADL

SEQ ID NO: 4555 - protein, 63 aa, synthetic construct
KMRWWHKMFRLLSKRAAKKIILLDRHKKRLKLWLPILMKYEILATAQAPRAGAGANVALYSKV

SEQ ID NO: 4556 - protein, 32 aa, synthetic construct
LMKYFRKWWKRFKRFHLRAAKVEPLTAHALTK

SEQ ID NO: 4557 - protein, 29 aa, synthetic construct
LLKYMKKFFKRLKKAHAKMAWDLACAAVK

SEQ ID NO: 4558 - protein, 39 aa, synthetic construct
FMRILKKIMKLFRTLFAQWAKSKRYKAARARAVLYASVW

SEQ ID NO: 4559 - protein, 30 aa, synthetic construct
LLRLIRRLYKRMKNPQAKVLYNASAILKAK

SEQ ID NO: 4560 - protein, 24 aa, synthetic construct
WLRYWSRLLRYFQKLCKKRMLSRA

SEQ ID NO: 4561 - protein, 27 aa, synthetic construct
KLKIWRRMFRKLQRALILLIWKCAPAR

SEQ ID NO: 4562 - protein, 78 aa, synthetic construct
LWRMLKRLLKRIKSAHLPRLNKLNFRFGWTMKKKNKYALAQYKAIKLVLKLAFQQMAMDAQKRAHMNQLAVMLWYARA

SEQ ID NO: 4563 - protein, 43 aa, synthetic construct
RYKLWPKWWKKLRRAAILWPLALPNKLKKAFYAKYRLMREDLL

SEQ ID NO: 4564 - protein, 32 aa, synthetic construct
MMRLICRLLKRFTRAAKALRAEQKDKITISEL

SEQ ID NO: 4565 - protein, 73 aa, synthetic construct
LLRLFRKFMRLMKRLDRARMKLLTMAFAKKDWHMLRNKRAMHKRDARLKMWKALKLAHAMDRLLYRQKNQRYD

SEQ ID NO: 4566 - protein, 79 aa, synthetic construct
RLKILNKLLKKYRKCYGVAKSYAVLASQHLMSCPQAMRWLRCDWIPPKRALSRLIKVAYARKAIFLKARLVDAATKRLL

SEQ ID NO: 4567 - protein, 31 aa, synthetic construct
LLRMLKKYLRMYKKVLLRKDHWCGLLNHKFK

SEQ ID NO: 4568 - protein, 28 aa, synthetic construct
MMRLIRKLLKRLNRGPCYFWAAAQLAQK

SEQ ID NO: 4569 - protein, 42 aa, synthetic construct
RWKLLRKLWKKMRQCLSVRLRHARKELHHCKALLKIMPLALR

SEQ ID NO: 4570 - protein, 34 aa, synthetic construct
KLRFFKRLLKKLHRRWAERCFRGKRKNLAAAIIL

SEQ ID NO: 4571 - protein, 25 aa, synthetic construct
LFRIFKKFFKLLSRLFCKKFALRRA

SEQ ID NO: 4572 - protein, 54 aa, synthetic construct
RFKYICRLFRKLCRIENYLKKRPAHLKLYFLNKRELRQEACALLLGRDKPHKAP

SEQ ID NO: 4573 - protein, 98 aa, synthetic construct
YLRLLKRLLKYIKRRRRWRRADLFRPATKLRLKQIQAMKNLLSAAKYEYYKKILLFLASKGAQTWEKNLNAIDGALSKRDMRYFFLLIGQKYAWQKRL

SEQ ID NO: 4574 - protein, 48 aa, synthetic construct
LWKLMTRFIKLFRSLDFAFALRQALLRLARKPQYKTVRKKEREFARWD

SEQ ID NO: 4575 - protein, 99 aa, synthetic construct
LMKLFRRILRLWKRDAMENIHRRYERLKKWKHKKKRKAKLISNRKYLRLFLVLVKVIAMWNMRREVRALKKKYCMLEASASLPAIKLKTTARCGMPLVK

SEQ ID NO: 4576 - protein, 58 aa, synthetic construct
WLKIYPKFLRKFKPSARARVAKLFNKRLLEMIRHKEKLQLPRALKRRKFPISLDLFYR

SEQ ID NO: 4577 - protein, 79 aa, synthetic construct
KLRLLKRMLKRLKRLLGFPKDNAAAERKVFVCSDKRHARSLRMKRAAKKMHNKLEGAAHDTDCKCKLRWPGDFPKFKKL

SEQ ID NO: 4578 - protein, 49 aa, synthetic construct
RFRLMSKLFKRLCKSRLKLWKAGADMKKLLIGAVAFARLRKRAKQLLAA

SEQ ID NO: 4579 - protein, 49 aa, synthetic construct
KLRLWQRYFKRLQQLVVARLRLRKRMLIVLAPACARAHKASACMAMHPI

SEQ ID NO: 4580 - protein, 51 aa, synthetic construct
RFKYLKRMLRLFCRLNALGKCKAFNLFKRAYAVAAKRWKMGPANALHGMQA

SEQ ID NO: 4581 - protein, 37 aa, synthetic construct
RLKWYHRMIRRICKYATADLELLAKAADAIMVPKARA

SEQ ID NO: 4582 - protein, 61 aa, synthetic construct
RFKWWKRWFKRLRHKLLKADAVCHPHAAYKVARLLACSLRRLAVDVKAFATVIVSKLAHKE

SEQ ID NO: 4583 - protein, 69 aa, synthetic construct
KLRLWKKMLKYFRPSLHAWRAFLKTRRRPSASRRLLCRAGRACPLLIKSARLKCLCEKAARAQTARRHN

SEQ ID NO: 4584 - protein, 46 aa, synthetic construct
KWKLFRRLMRKMHKWFAQRGRQAVARGLRMRKAAAIKPALLLMHCW

SEQ ID NO: 4585 - protein, 33 aa, synthetic construct
RYRWYQKIIKRFKKKLSALAILAKKAEVFKLHL

SEQ ID NO: 4586 - protein, 83 aa, synthetic construct
WLKIIKKYLRFMQCPAADLATARRRPKPNLARLIACLYINKYRARRFTKKSVAAHLNKNRHKGGAMKKEKARKVLLKQGKWGK

SEQ ID NO: 4587 - protein, 57 aa, synthetic construct
KFKMIQRLWKLLRNLQKTMRLLAVKYGKRPLMMASAEALFSLLDKDVRRRCAKYRHR

SEQ ID NO: 4588 - protein, 78 aa, synthetic construct
KIRLMKKYFKKMHTQLGVIETKTAHGATDKKYLKKLMKGRKHPARRRCKAILYLLRPHLLLGLRLLRTMALKLRRLFG

SEQ ID NO: 4589 - protein, 22 aa, synthetic construct
WYRLICRYFKFLKRSQAAKLAR

SEQ ID NO: 4590 - protein, 20 aa, synthetic construct
FFKWLTKLIKKIKRKQAWLL

SEQ ID NO: 4591 - protein, 25 aa, synthetic construct
RLKLLCKFWRKFKKALVFGHAWLLR

SEQ ID NO: 4592 - protein, 55 aa, synthetic construct
KIRWMSRWFKFLKRLQKARHSKLCAKARRKLINTRRLLHLKRAHYLLRKLVYRLQ

SEQ ID NO: 4593 - protein, 97 aa, synthetic construct
KMKYMPKYMKRLSRGGEITAAAATQRLYTAVWKGKIALRCRAYKENLVMFRKLDPALHLKAPAARRRFRRGSKRAPLKANDLANKGQALAPLLLARE

SEQ ID NO: 4594 - protein, 53 aa, synthetic construct
KIKLLNRFLKKLRKLLKNVNDELSAIILAANEWICFLKASSKYKALATKLTRL

SEQ ID NO: 4595 - protein, 32 aa, synthetic construct
RLRWFKKFLKFWTCRYKRALLPWAAFQLKRTM

SEQ ID NO: 4596 - protein, 81 aa, synthetic construct
KLKLYKKWYRRFPRNNTKYQRAEIKQAARVWALKLKQAGSMAPAESRELKWALRNTEARARHWAYAYRLHMAALKERAKAA

SEQ ID NO: 4597 - protein, 32 aa, synthetic construct
LLKYYTKFLKKLPKELCRARWCELAFAAFSRG

SEQ ID NO: 4598 - protein, 67 aa, synthetic construct
LFKFLRKLFRKLHRHMSCAGCLAIGLRRQAVWRKKIRDPALKLRTRQVYPYRELHLAASAKRGRKMA

SEQ ID NO: 4599 - protein, 54 aa, synthetic construct
MMRFLRRLLRRYKTGNQQRVLDKKVKLALSILLRLWYDATTEWLAFRKKAARLC

SEQ ID NO: 4600 - protein, 84 aa, synthetic construct
RFRMINRWFKKFRRAKAVKGKALLKYKLKLDLARTQVKALAAGKAAQLWRRLKLKWPFEDKDGASVETQRNWKCQALLAQGRKE

SEQ ID NO: 4601 - protein, 97 aa, synthetic construct
KWKMFRRLLKRFKRKDTLERPRMNHAKKKLRACGRNVKMMAKRIWIDARALLKASITLRAKDLMQARDKRAHVCYLMFKPACRKLSAAKWQSKKRAA

SEQ ID NO: 4602 - protein, 26 aa, synthetic construct
RFRILSKIYRKLKHWRARVQILLAFL

SEQ ID NO: 4603 - protein, 30 aa, synthetic construct
LLRWYKRLFKFMPRAKKAATGRQLKRGLDI

SEQ ID NO: 4604 - protein, 67 aa, synthetic construct
RFKFLKRFYKKWRKRAVGKWCLYDRLKAYAGEGKAYIKVARDASEWLLRAAARLQNLCLLAAFNAHR

SEQ ID NO: 4605 - protein, 44 aa, synthetic construct
RIKLMKRLFRKMRNRLRMLYAKLPAPYAPKRDCMNKRRWSDLLA

SEQ ID NO: 4606 - protein, 23 aa, synthetic construct
YLKLYNKLLKLMPRRKLAYKCQQ

SEQ ID NO: 4607 - protein, 20 aa, synthetic construct
LFRFLRRILKKLKCHYLFTQ

SEQ ID NO: 4608 - protein, 39 aa, synthetic construct
WLRLYPRLFRYMRKLKVNLALKVQLSRLRTKKAKCREAK

SEQ ID NO: 4609 - protein, 38 aa, synthetic construct
KWRLLKRYLKYLKCLLLLTSEYQCWKMLPKRALFCRYQ

SEQ ID NO: 4610 - protein, 81 aa, synthetic construct
RLRWMHKLLKRWKTCAALNTARLRFYHLKVAASLRKLRRRPKIEEGRCPHALLDARKRDGEKAACQLKKLKKTMNVQHAFP

SEQ ID NO: 4611 - protein, 56 aa, synthetic construct
RYRLYKRIFRKIKSLQLMAKCKERRLAPLPNYMRIFLRPARGLLLRFALKALRLPE

SEQ ID NO: 4612 - protein, 40 aa, synthetic construct
MWRYMTKYFRRLSSRRHKGQRAKRDNLGLEKYLLKAHKLL

SEQ ID NO: 4613 - protein, 50 aa, synthetic construct
FLKMFKKILKKLCKLQYRLAPTDSEHRKAARPIGLKIYKGELAWLAAKKF

SEQ ID NO: 4614 - protein, 26 aa, synthetic construct
RLKLLRKFLRYFSRLSPAALRSTSLH

SEQ ID NO: 4615 - protein, 38 aa, synthetic construct
FFRLMKRMFKRFNKLEAWKPNAKKFWRACLAMLKLLNY

SEQ ID NO: 4616 - protein, 45 aa, synthetic construct
RMKILKKLFKKLTHARKLLLKREYVLLLWQRTLPRKYAQYMLFAE

SEQ ID NO: 4617 - protein, 24 aa, synthetic construct
FLRFIKKWLRRLPKLLAWDRKPGE

SEQ ID NO: 4618 - protein, 59 aa, synthetic construct
KYKWWTRWIRKLKNYKMARTQAITFYLCYLVRKAWTALALKLVKAKLCLARTRHERKAV

SEQ ID NO: 4619 - protein, 25 aa, synthetic construct
FLRFLRRLFKMMNRRAQYLLAWCLR

SEQ ID NO: 4620 - protein, 95 aa, synthetic construct
KYRLLTRIMKRIKRWRRLQATKCLGLKHKRRHRQAKLKAIWVIPYAQRPDEIRTTCLAARLAFIAKKKLRSANARCRLRAEHLKGSKAHRHVNRF

SEQ ID NO: 4621 - protein, 29 aa, synthetic construct
MYKILQKWIKFIRRQVRLAELVLKRRLLG

SEQ ID NO: 4622 - protein, 34 aa, synthetic construct
KLKWLPKLMKRMRKLSHQQYAASAHRKFLLLRKF

SEQ ID NO: 4623 - protein, 75 aa, synthetic construct
FFKFFKRLLKKWHKVRRAFVDALLFLSIMYLRDENKRKLRKMKMKARADAFGKKRLEARLLNKSEARLRGASGFL

SEQ ID NO: 4624 - protein, 25 aa, synthetic construct
MIKWIKKLIKRLKSCLARVLRSRAA

SEQ ID NO: 4625 - protein, 63 aa, synthetic construct
RWKLWRRMFRFWTRRPTKMALCARAGKCLFRFLILPHALRNRQRHLVVLAAQYVTAKRLQALK

SEQ ID NO: 4626 - protein, 41 aa, synthetic construct
WLKYFHRYFKKLKKAELYASRMCSAARAKKSAAACKRRKMR

SEQ ID NO: 4627 - protein, 84 aa, synthetic construct
KYRFIRRLLRRLNNLGDKLAQGKHWKRKLKKALVTTVCCDFQLRVTALRLSRACARRAKAIAATVKSKLRVTKESHRDRKKCLL

SEQ ID NO: 4628 - protein, 37 aa, synthetic construct
YLKLFSKLIKILKTAKGKIKKRFPAAVRVKLHPPALR

SEQ ID NO: 4629 - protein, 29 aa, synthetic construct
IMKLMQRLMRKYRRMNLWALRRCAKIMLF

SEQ ID NO: 4630 - protein, 44 aa, synthetic construct
RLKMIKRYYKRFRQAKRHSARKLRLFLIWWLARSANPAAALPCD

SEQ ID NO: 4631 - protein, 82 aa, synthetic construct
LFKFYTRLLRLYQTDKRQPAFLHELKLIRMEARKYALRFPWRCWVRAKKHAKRLDRPALMRACDLAYLVLWGREKKKKERLK

SEQ ID NO: 4632 - protein, 24 aa, synthetic construct
RLKLLCKWMRKLRKQAAAWLVGPE

SEQ ID NO: 4633 - protein, 33 aa, synthetic construct
LMRLYKRLLRLMCKEDIKYKAAAARMNFLKEAR

SEQ ID NO: 4634 - protein, 55 aa, synthetic construct
KLRFFKKIWRRIKKKKARLLAWAWGLAKANRCRSTHLRKNSQYWAARLKWRFPTA

SEQ ID NO: 4635 - protein, 41 aa, synthetic construct
KWKMLKKFLKRLCTRIDKLAAPYHPRQRADRRDMLQLFCAL

SEQ ID NO: 4636 - protein, 23 aa, synthetic construct
FLKLFRRLLKWFKRQAELSDWAL

SEQ ID NO: 4637 - protein, 34 aa, synthetic construct
KYRLYRRLYRWYCTKLKMKHQLKGNVLLLLNREA

SEQ ID NO: 4638 - protein, 58 aa, synthetic construct
RFRWFNRFLKYFTKDLAARLDQRAKCAKMRLKRQIKVNAIDTAALAVHRCQASLKKLL

SEQ ID NO: 4639 - protein, 31 aa, synthetic construct
LLRMYKKMFRRIKCKLAAKLAEYRQGGFRAK

SEQ ID NO: 4640 - protein, 27 aa, synthetic construct
KYRLWKKLWRLIPNQNAASRQTLLAPK

SEQ ID NO: 4641 - protein, 68 aa, synthetic construct
LLKFLRKYLKLFKRMKLLKARWLFRDLAWYALLFHQPLIARAYKKKRRVAAQKMIWYSGIKIKSKQGS

SEQ ID NO: 4642 - protein, 73 aa, synthetic construct
KLKMLKKIIRFYHRNPKRVLAHKRADPLLYDCAVAELDMASLTYAAARAKRLDWLMARWIRRAKAQCKGKGRL

SEQ ID NO: 4643 - protein, 38 aa, synthetic construct
RWRILKKFLKWIKHPGAWKIGRLLRLRSLRTPLTQKAM

SEQ ID NO: 4644 - protein, 32 aa, synthetic construct
KIRFMRRYLRLLSRLAKYKWFLATNMYDKPLR

SEQ ID NO: 4645 - protein, 47 aa, synthetic construct
RLKLFNRILRRWSTSKKKKNERPCRWWLKLCNVRGLNEKLLAADPAL

SEQ ID NO: 4646 - protein, 28 aa, synthetic construct
RFRIMPKLLRLLPTHEARPQLKWRLLWL

SEQ ID NO: 4647 - protein, 27 aa, synthetic construct
FLRWFTRWIKRLRPRLTMWQAKLYLRA

SEQ ID NO: 4648 - protein, 87 aa, synthetic construct
KLKLLPRLLKLLTHHVLVKRRVRRLEPPLRKKAMCMAHFKNAATLKLRFPALKEFLSLFHKRMRAACLAYADMLIACDYKCEWYRQA

SEQ ID NO: 4649 - protein, 36 aa, synthetic construct
RIRIIRKLFKRLPPAAKRILAKDAYKWLTGLAYLDQ

SEQ ID NO: 4650 - protein, 42 aa, synthetic construct
RYRFWKRYLKFFKKVVNFETKALYSKAGLRLDLLRLRKQQLR

SEQ ID NO: 4651 - protein, 22 aa, synthetic construct
LLRYLRRFLRRFRRICANLTKC

SEQ ID NO: 4652 - protein, 53 aa, synthetic construct
KLKMYPKFFKKWKRDAGKACEYRLVFLRHLLLKLQKREIRKTIALRLARGNFG

SEQ ID NO: 4653 - protein, 27 aa, synthetic construct
KIRYLSKLLKRLPRDHFSFLLQSALKL

SEQ ID NO: 4654 - protein, 22 aa, synthetic construct
RYRLFKKYYKLIRRACLATAKQ

SEQ ID NO: 4655 - protein, 60 aa, synthetic construct
KFKWLCRYWRLLCRDAAAMRLGVSKYDLATRRKKQYLLQLKKKVWPARLMLLDIKGRYAG

SEQ ID NO: 4656 - protein, 30 aa, synthetic construct
RWKIFNKFIRLYKRAVARLRLELLLRTTII

SEQ ID NO: 4657 - protein, 25 aa, synthetic construct
KYKILCKIYRKLRKKAKILAMAARA

SEQ ID NO: 4658 - protein, 47 aa, synthetic construct
RYRLLRKMLRKMRQCPRNAFSVPEACQRKATLMARLKKPLNAKPLCS

SEQ ID NO: 4659 - protein, 43 aa, synthetic construct
FFRWIRKLLKMLRRCRAKAFDLRKCDAMAIILNCKGRILLNLI

SEQ ID NO: 4660 - protein, 33 aa, synthetic construct
FLKYLRKYLKRYPHPKVVNLRWQLRTLLRLKSR

SEQ ID NO: 4661 - protein, 33 aa, synthetic construct
KLRLITKLFKRLTNNKKLRLAAPRAAWIRCDMR

SEQ ID NO: 4662 - protein, 23 aa, synthetic construct
MLRLLNRFMKFLSKKLAGSNKLS

SEQ ID NO: 4663 - protein, 27 aa, synthetic construct
LWKLLPRMLRKFHHTAKKAKMDCLRAA

SEQ ID NO: 4664 - protein, 23 aa, synthetic construct
IWKLLNKLLRKFNRPRLAARQVH

SEQ ID NO: 4665 - protein, 59 aa, synthetic construct
KIRFIRKWIKFMRCRACADLCAVIAPVAQKKYKRLKAREWLRLPKYARLRLNNRDAECR

SEQ ID NO: 4666 - protein, 45 aa, synthetic construct
RFRLYRKMLKKFQCFARVSDASGARLKNRNIKLQTRLKKAPLRFL

SEQ ID NO: 4667 - protein, 76 aa, synthetic construct
FLKLLRRYLKRLRKDARPRGPNGGFRLLHIKKCRAAALWHWSGCSKRRKNVKLKAVMRKAVALRFCLHCYNFPARA

SEQ ID NO: 4668 - protein, 37 aa, synthetic construct
RLRMLKKLWKWLRKEYKANLRSPAGLYKKKHVAEYAF

SEQ ID NO: 4669 - protein, 34 aa, synthetic construct
MFRLLKRYLKFYNHKIAAHKRRLNKALNKKNRAN

SEQ ID NO: 4670 - protein, 31 aa, synthetic construct
LMRFISKLLRWLRKKEEIRQNLRKLYRAAMA

SEQ ID NO: 4671 - protein, 28 aa, synthetic construct
KLRWLRRWLRRLRQWRLLWAIKDEKGQA

SEQ ID NO: 4672 - protein, 75 aa, synthetic construct
RLKILHRMMRWFRKPIKYTRRFLLARLDMNIANRRPRQLRAALKELKRLSLPRSCRKTGKATTCRQLTKAEKLRC

SEQ ID NO: 4673 - protein, 88 aa, synthetic construct
RLRLFKKFFKKFCRRILAYSMRKLWTKCWRFFEANWIRKLKHAVYRAPRAEPLASIKRWNTYAWASKRCKTLKNAKAAKFERWKLAAK

SEQ ID NO: 4674 - protein, 20 aa, synthetic construct
RFKWMKRYFRWLCRLPAEAL

SEQ ID NO: 4675 - protein, 22 aa, synthetic construct
LLKFLRKILRRFKSLLNHRRYM

SEQ ID NO: 4676 - protein, 69 aa, synthetic construct
RFKMWRRLWKKLKHLANAKKGRLGAKRKVALRWEKKRRGQDAYKIYALTCLAHTDINAWEGLHRIAKII

SEQ ID NO: 4677 - protein, 43 aa, synthetic construct
YIKYLKRYWRKLKKLKQPLDMERRSCKHDHLLYLIHKRLLKQA

SEQ ID NO: 4678 - protein, 44 aa, synthetic construct
KLKIMPKLIRLFRRKGAMKLQDWTDLLQYVKLKNYLCARAGALK

SEQ ID NO: 4679 - protein, 20 aa, synthetic construct
LFRLWSKLWKWLSQRKLAFQ

SEQ ID NO: 4680 - protein, 80 aa, synthetic construct
FWKIFHKLWKKLRKVREFARELRFLNDNYAKRNEAALPRPLNTPKNRFRHYTWRLAAKAKQMAFLLLVKRLSRLCARAAR

SEQ ID NO: 4681 - protein, 34 aa, synthetic construct
IMRWLNRLYRLMRRLRRTDANIVTHGARRAKRAA

SEQ ID NO: 4682 - protein, 55 aa, synthetic construct
RYRILQRFWRRLKKNRAASGDAIAAHMAGREQRLRMHVPFAYKLVLKALRLPKKR

SEQ ID NO: 4683 - protein, 23 aa, synthetic construct
RFKIMTKLFRLLRKKLVASFFAH

SEQ ID NO: 4684 - protein, 26 aa, synthetic construct
LMKLIRRLIRLFHCNMDLKAKKEALK

SEQ ID NO: 4685 - protein, 37 aa, synthetic construct
FLRILRKFMKKWCTRNIKKCLKAYCGLRSLARAHLLI

SEQ ID NO: 4686 - protein, 41 aa, synthetic construct
FFKMWKKFFRLFKRIALAKNGSRALAKLLRAYIRRSAAATV

SEQ ID NO: 4687 - protein, 33 aa, synthetic construct
WLKLFNRLLRRFSKKARRALLCNAMAARKDRAG

SEQ ID NO: 4688 - protein, 47 aa, synthetic construct
LMKLFRRFWRIIQRRRARLTKRSANASLTIKLYKAMQARWRWALNDI

SEQ ID NO: 4689 - protein, 54 aa, synthetic construct
RLKWFCRFWKFWRRRVKNKLLPALAYRSLDKAKLKHAHKLLYNDKAKPLREKKE

SEQ ID NO: 4690 - protein, 30 aa, synthetic construct
FFRYFRRYLKRFRHLKINERFLRALACANR

SEQ ID NO: 4691 - protein, 80 aa, synthetic construct
FMKYLKKWWRLYTCKLHDKQKYKMARIVRYGPNKKLLRADTKYFKQRLKKKQARAAADHAKTPRELKIEMKLKLAMRLAV

SEQ ID NO: 4692 - protein, 34 aa, synthetic construct
ILRIMRRILKRMTPACAEAKNAKAARLAQRATKW

SEQ ID NO: 4693 - protein, 30 aa, synthetic construct
FFRLLRRLLKKFSKCALFWQWRRLKDLRAS

SEQ ID NO: 4694 - protein, 82 aa, synthetic construct
RFKWFKRLIKFYKSQAWQKQRWKALLAHARKWAKDRLALLRHHLDAKMSTVGRLKDKLMLKMMLQLLRARWEHLEWLAALKR

SEQ ID NO: 4695 - protein, 32 aa, synthetic construct
KWKLWRRFIKRLCRMAARNFNRAAAPQEFKKA

SEQ ID NO: 4696 - protein, 47 aa, synthetic construct
LLRLYHKIYRMLNTLLAAKDVYLTKWAEWRFLLDAKHKKGANWSKAR

SEQ ID NO: 4697 - protein, 31 aa, synthetic construct
WYKLLKRYLKKFRRARAEMSRKLAAMENNPL

SEQ ID NO: 4698 - protein, 64 aa, synthetic construct
MYKFLHRFLKKLRHAGAYRLRGARLSSKLLPARKRAARYKVDTRAERWWVLDIQRHLLRFVLSP

SEQ ID NO: 4699 - protein, 48 aa, synthetic construct
LFKLLRRLLRWWKRARRRPVFRRVLTLGDWYKLNLLCRDLWIRCAWAG

SEQ ID NO: 4700 - protein, 39 aa, synthetic construct
RMRMLKRMLKLFQKARNLPSLTAANLVGMLARFCKYKKK

SEQ ID NO: 4701 - protein, 94 aa, synthetic construct
YLRLLCKLLKRMKRPPYRRKLWRRACRWNAAAAELQSDALHLWLVYALKLRCLVERHCKKKAKLDRLPLWMDAAIDSAGSLRNPRKYRWLRFMA

SEQ ID NO: 4702 - protein, 32 aa, synthetic construct
KFKIMRRLLKRWTQALPLLLWTDAKSRVANRR

SEQ ID NO: 4703 - protein, 57 aa, synthetic construct
FIKLLSRILRMFKCLDKGRKKSLSLGKGQYHGKAGTLADKCKLKAELDLNKLELRLK

SEQ ID NO: 4704 - protein, 22 aa, synthetic construct
LWKFWHKLFKRLQKKLAAGASE

SEQ ID NO: 4705 - protein, 56 aa, synthetic construct
KLKWMPRFLKKIRRLDGNTALHTNEDVMKYKKRRHRELPVPFLKKKLLWLACRARA

SEQ ID NO: 4706 - protein, 53 aa, synthetic construct
FLKYLKKLYKLLRRKAKEWLVKATLQAFRKRKFKPLPQNARNLRYSPQKKTML

SEQ ID NO: 4707 - protein, 63 aa, synthetic construct
LLRYFRRLYRKIRTIILADRLYNLDKAARAFHDANRAFAKALLRALDYIKRKPGRERRKECLF

SEQ ID NO: 4708 - protein, 51 aa, synthetic construct
KYKLIQKIWRKIRQLLGKRSAKKALRLPKTAWRQALRIDMLKENIYNKLGK

SEQ ID NO: 4709 - protein, 29 aa, synthetic construct
RLRFMKKLLKRLTRLDINSCLYLAAYWRA

SEQ ID NO: 4710 - protein, 74 aa, synthetic construct
KFRFLKKFIKKMKTKLISLWKLIAKGLTRPLSYKLAYIKAYAAQAKKKRFKEFRRVRLRLQGYQRKPLHAHFVP

SEQ ID NO: 4711 - protein, 30 aa, synthetic construct
WYRYFQRYLRKLKQRVRLWRARELCSPKAL

SEQ ID NO: 4712 - protein, 26 aa, synthetic construct
RFKWLRRYFKMFRQLKRLAAGLLHLI

SEQ ID NO: 4713 - protein, 63 aa, synthetic construct
RFKLWKKLFKLLNQARAQTAITGAKAPRWCQLFDKELRVKLLLPQLAMFRRPNRCEGRIKKAL

SEQ ID NO: 4714 - protein, 38 aa, synthetic construct
RWKFLCKIIRRYKPFAAAFPKQPAARLVCKYKLRWRDA

SEQ ID NO: 4715 - protein, 86 aa, synthetic construct
LLKLLRKFWRWWRQFTARAYDARKLRHYKKLAAKRSLLKRDLKRYAQRASANPKHKAFDEALRMGQWTIKGPMTIKRKSILKGGAR

SEQ ID NO: 4716 - protein, 20 aa, synthetic construct
KFKYLPKILKRLNNAANLLC

SEQ ID NO: 4717 - protein, 26 aa, synthetic construct
KLKLLRRLLRLFRRFENAANLLRRWI

SEQ ID NO: 4718 - protein, 23 aa, synthetic construct
RLRLFKRFLRRLQRLKLGNHCAA

SEQ ID NO: 4719 - protein, 41 aa, synthetic construct
IYRFLHKLYRMLKKKACKKLCNRLKRLACALFQLAMSQISR

SEQ ID NO: 4720 - protein, 20 aa, synthetic construct
RLRLYNRMLRKLRQCRMDAG

SEQ ID NO: 4721 - protein, 25 aa, synthetic construct
MLKLYSRMLRMFRRHTLRRKLVNNA

SEQ ID NO: 4722 - protein, 73 aa, synthetic construct
RWRLYRRFLKRFQPRLDLKRRSRKAKYEQLRLKKQVRQKKTALFFACRKYRRALYWLAASMLTKCLADCKWRL

SEQ ID NO: 4723 - protein, 66 aa, synthetic construct
FLKWLKRMFRYLKRRRWYWFKLALFNMRLEFDRKAKRKYRFDCLALWKSALPYFLDILACKKLYRN

SEQ ID NO: 4724 - protein, 21 aa, synthetic construct
FWRLLPRFLRKMKKTKIAHPL

SEQ ID NO: 4725 - protein, 37 aa, synthetic construct
LFRYLRRILKKLRNHARLLAPMKLMRMPCLDPARASH

SEQ ID NO: 4726 - protein, 24 aa, synthetic construct
KLRLFTRILKRYKSMLHKAKTCAA

SEQ ID NO: 4727 - protein, 80 aa, synthetic construct
RMKLFPKLIRYFKKAGQFLRNMHARKCSLVLMVWALDLPARYRMRMAAVDRWAYQKLYWALKRKRAYKKGLGAKAAQKDT

SEQ ID NO: 4728 - protein, 63 aa, synthetic construct
FYRLMCKLWKWMRNALCPRLRRLTLDARQEMRRALMHPRQLRVRKICKPLRLKLRFRALPQYM

SEQ ID NO: 4729 - protein, 34 aa, synthetic construct
LMKIFKRLLRLLSKTRVKRIIAKFKIYCANKLNC

SEQ ID NO: 4730 - protein, 77 aa, synthetic construct
RMRYWKRFYKYLKRRALYLAGKWKDKLPTTRRKILARRALTNARAASNLVTKYAHARLMKRLRNTLPHQLGKWMADD

SEQ ID NO: 4731 - protein, 39 aa, synthetic construct
LLKLMRKLLRRLKRTKIARADPVTADLLLKCDRKLNVRK

SEQ ID NO: 4732 - protein, 69 aa, synthetic construct
FYKLFRKLFRLYCKPAKALRLAADCMSSCVANYQRARARQQSDLRWFLERRRMKQKLPARKKDPRSSKL

SEQ ID NO: 4733 - protein, 27 aa, synthetic construct
KLKLLKKMLRRLKKDAPVFRCLATICA

SEQ ID NO: 4734 - protein, 62 aa, synthetic construct
LLRLWKKILRKYRRHSKNAMFIHLEQKKRDRAVAKKTLGYEWAKARASAVIRAKALLHKESC

SEQ ID NO: 4735 - protein, 34 aa, synthetic construct
RFRFYQKLLKKFNKLAAILRLEIDETALATIARF

SEQ ID NO: 4736 - protein, 35 aa, synthetic construct
FLRLWPKYIRRLRTKTARQNAAFISRLQLKASSAK

SEQ ID NO: 4737 - protein, 32 aa, synthetic construct
LFRLIPRWWRKLKCKLLVKFDKAAERCALKCK

SEQ ID NO: 4738 - protein, 55 aa, synthetic construct
RWRLFTRLLRRLTKNWFSRVIAWSLLCFRDVATLGAKRWYLKGKLLAKLSKATRW

SEQ ID NO: 4739 - protein, 35 aa, synthetic construct
RMRWLKKLYKFLPKKAKIMKMAAAVWKWFLAYDKR

SEQ ID NO: 4740 - protein, 51 aa, synthetic construct
LIKMLSKMIKLLSREWMKWRARRRKLPAYHRRLKFLAAKYAMQAHRMKSSN

SEQ ID NO: 4741 - protein, 34 aa, synthetic construct
FLKMLPRLLKKMKCKWNPTKAEYAAIKASELAMA

SEQ ID NO: 4742 - protein, 32 aa, synthetic construct
FYRWLKRLYKLYCKHSTRRLLAKAMAKDLLHV

SEQ ID NO: 4743 - protein, 30 aa, synthetic construct
RWKLLKRFIKWIKQAAKGARPYATRALYMI

SEQ ID NO: 4744 - protein, 20 aa, synthetic construct
LYRFFKRFMRRLKSLAKLNM

SEQ ID NO: 4745 - protein, 60 aa, synthetic construct
RLKLLKRFWRRFSKDGIETDNWRKLAGRVALNIRAAAKWALQLQRRAFNLRQRKICKRQF

SEQ ID NO: 4746 - protein, 73 aa, synthetic construct
KFRLIRRLWRKIKKKRSAERLWWRAVILNTILALGERRNACNMLMTNACLARNRSWKTLKRAKNAMDGLLRLV

SEQ ID NO: 4747 - protein, 36 aa, synthetic construct
RMRWLRKIFKKFRRGAKALKRRCAPALWILIELIAN

SEQ ID NO: 4748 - protein, 66 aa, synthetic construct
LFKLFCRLIRILKPAKSLQLQQAACLRRAERAFRIMCRKRHRTFHAHADHKKLEVLYAFKTKLKRR

SEQ ID NO: 4749 - protein, 41 aa, synthetic construct
KYKWFRRMIKRWKRAAAQAACKASPLEDFTKKPLLRIILLD

SEQ ID NO: 4750 - protein, 85 aa, synthetic construct
RLRLWPRIFRFLKKMWTKRKWLDARRDDFSKHLAALRQMKVLNFFAATTARRYWRHRRLLEGALMPCAIQPKLGKRKKKRRNAPE

SEQ ID NO: 4751 - protein, 38 aa, synthetic construct
KWKFLRRFMKLFKHVALAQNERAPVLRPAYLRRVILHR

SEQ ID NO: 4752 - protein, 40 aa, synthetic construct
RFRFLHRMIKFFQKLAGLKAKKATLKMLIWRRKCGAILRN

SEQ ID NO: 4753 - protein, 60 aa, synthetic construct
RIKYYKKWYRLWNKRKCKAGKSYGKFFIAAFLYLEAKILKKLAGGLKRREASEAHRAAKC

SEQ ID NO: 4754 - protein, 72 aa, synthetic construct
LIRFLRRWLKFFTRPLQAVEAMLKLKCLRVKWEKANHELLHRKWQALIHCAVRQSLLRAYERRKKAKRMGMR

SEQ ID NO: 4755 - protein, 72 aa, synthetic construct
RMRFFKRFMRRMRRENLIMKKAWLLKLLERFKRRAARRHAFACNLQILTVKMPWDQRAKAEALTLTYWKADK

SEQ ID NO: 4756 - protein, 74 aa, synthetic construct
FLKYIPKYFKRWSKAERFGCVRLKKELLAENKCKFACVRKRTLFAFPDKRLLHKVYHAALVKKAALGLGMRAKR

SEQ ID NO: 4757 - protein, 78 aa, synthetic construct
RIRLYSKLFRILQRLRVLHQKMWAPEKRKVRTRRTWLIAHSLGKLRRSRAGLRMAILAKIKQLIRRMKKANIAQSVTR

SEQ ID NO: 4758 - protein, 68 aa, synthetic construct
RFRFYNKLYKRYRKELLKARQMLAEQHIRNIAKSKKALKSRCSVKWMRRALLALKRAMASAKEARKAN

SEQ ID NO: 4759 - protein, 54 aa, synthetic construct
ILRLFRRLIKWYKHTRMNKLRAVWAFFDKARFREELLKLCLLRADPLANAYANA

SEQ ID NO: 4760 - protein, 40 aa, synthetic construct
KFKILKKLFRRFKNARRVIAALCHGYRANRADAPVIRHRM

SEQ ID NO: 4761 - protein, 34 aa, synthetic construct
RIKLLKRFLRLLRRHPLLWGYPDLEAQRHRWALD

SEQ ID NO: 4762 - protein, 78 aa, synthetic construct
KFKLWQKMLRKWHKRELRARAWWLMRNQAPYTHAPVKKARLAERAFLFMCSRLATRWRLRKSLLNKTCLRARTGRTRA

SEQ ID NO: 4763 - protein, 21 aa, synthetic construct
LMRLWHRFLRLLKPYYRRCRA

SEQ ID NO: 4764 - protein, 40 aa, synthetic construct
LFRIFRRLMKILNRCRNSKLARDHARRRRILVLRIDHAID

SEQ ID NO: 4765 - protein, 22 aa, synthetic construct
RLKMLKKLWRRWKPAAMHKALR

SEQ ID NO: 4766 - protein, 36 aa, synthetic construct
FIRLLRRYWRFIRQIAACNRCTLKLKMLKCHPRRAA

SEQ ID NO: 4767 - protein, 37 aa, synthetic construct
RLKILTKFLKKYKRWKMARPRCANKLWDRLNVALYLE

SEQ ID NO: 4768 - protein, 78 aa, synthetic construct
RIRFLQKLLRRFKREEKDCGRIGVELKFIAKALRRRKFQTRGAAQSPYRRKLWLYKAIAKAASPCMARMKSKILLYKG

SEQ ID NO: 4769 - protein, 23 aa, synthetic construct
KLRMWNRWLRLMRPVWLAKQRLR

SEQ ID NO: 4770 - protein, 29 aa, synthetic construct
FWKLLSRMMKIYPKGLHLRTRRLRVALLN

SEQ ID NO: 4771 - protein, 50 aa, synthetic construct
RLRWIRRLLRFLKKLLLRVKRYMMMRFMAVIRCTQLALLYAKKKARESAL

SEQ ID NO: 4772 - protein, 30 aa, synthetic construct
LLRFLPRLIRKMNQYAKRLRLAPINKAIRC

SEQ ID NO: 4773 - protein, 49 aa, synthetic construct
RYKFLRRLWRRLNSKTWRGKMAWRPDPAEMMKLSALLLRRLARQQRKED

SEQ ID NO: 4774 - protein, 87 aa, synthetic construct
RFRLIRKLLKYMCKAQLDLKKRLWDVKMPSGVRKALKPQKLKLTLGKRWVKYRRLALRLAKFRWKHKAAGSAYAPNDRFMMRAPRFK

SEQ ID NO: 4775 - protein, 21 aa, synthetic construct
LYKLLRKILRFLTRCLDYSKD

SEQ ID NO: 4776 - protein, 63 aa, synthetic construct
RWKLLTKMLRKYHRKRALCKAAAFDFKMRKKWLVSKLKCRRLARADRQALKLQQYVIKKEQPW

SEQ ID NO: 4777 - protein, 69 aa, synthetic construct
KWKLMRKMWRKFKKPWYMETKASHLRLRRARNMLEILANAKAPLQVPDERDLRALPMLKLAVVKNAAIK

SEQ ID NO: 4778 - protein, 20 aa, synthetic construct
LLKFMRRLIKLIHQRRFGLA

SEQ ID NO: 4779 - protein, 29 aa, synthetic construct
KLKLWKRILKRWKTFRLKHALLCRENLPA

SEQ ID NO: 4780 - protein, 45 aa, synthetic construct
KFRLICKLLRRYHRKALLIDAKDKDLKGKSAHKLCSYALLGKVLL

SEQ ID NO: 4781 - protein, 59 aa, synthetic construct
YMRMFRRILKLFQKKSSAHRTALRKKLWELIDGDNLALKNGHERRRPKKLYLSRRGLRA

SEQ ID NO: 4782 - protein, 89 aa, synthetic construct
RYRLMKKFLKRWHRSLLILKRAALEESWYQRARLRTNKRFRARRYQKTLPRLWQRLEKALCIKAQFIALTVLQDKTSFKLKMKNSCEAK

SEQ ID NO: 4783 - protein, 27 aa, synthetic construct
RYKLFQKYLKFYKKWAKQDAKCRNALA

SEQ ID NO: 4784 - protein, 20 aa, synthetic construct
KMKFLNRLLRRWNKAWMCAD

SEQ ID NO: 4785 - protein, 76 aa, synthetic construct
RFRWLPKFMRKIRPASPRCLSDADLHLTSRSWKAFRKIAAALQAARVRARHNALLKTCPNRAALKIKFRAFGKPQA

SEQ ID NO: 4786 - protein, 26 aa, synthetic construct
RMKFFQKLMKLLKKRDALWLFEARII

SEQ ID NO: 4787 - protein, 26 aa, synthetic construct
KLRLMNKLMKLIKNANLKPKIDPLEL

SEQ ID NO: 4788 - protein, 49 aa, synthetic construct
RYRLLRRLFKKLKCAILKKKQLGIAAARRKCQVQRRLDPFWIARIVVRA

SEQ ID NO: 4789 - protein, 61 aa, synthetic construct
RWRLWKRLFRMFRKVEDAIDARVIPAKKVKKRLRHWQAAGAAKALCKWLIDDRAAGLALYF

SEQ ID NO: 4790 - protein, 36 aa, synthetic construct
WLRWLTRLYKLWQQAPVFAANARPKKKRAQAKAGKR

SEQ ID NO: 4791 - protein, 24 aa, synthetic construct
KYRMFRKLLRMLSRILLFRDAVAM

SEQ ID NO: 4792 - protein, 56 aa, synthetic construct
KIRLLRRLFRFLKHLYRWWAAHAALERYDYEKFLRAFNLLKSHVHYLARQRLIKPV

SEQ ID NO: 4793 - protein, 52 aa, synthetic construct
KLRLFRKFLRFLRTDRKMAECARYVARRLLRILMSCATTHGFAKLKQQANRL

SEQ ID NO: 4794 - protein, 88 aa, synthetic construct
KLRWLRRMLRRLRKLAKVWNRKCKRDWAPHWKKLLTKRWAMKTLMARKRPPLKARGEKLMKNLDKIKLIAFCANLACELLRLLRMATQ

SEQ ID NO: 4795 - protein, 38 aa, synthetic construct
KLRLYNKMMKKFCQRKESKPYKTYHPQLAALAKAKARH

SEQ ID NO: 4796 - protein, 37 aa, synthetic construct
WIKIYQKFLRLWKKARTLRAAKNARGWADFKTHKDLL

SEQ ID NO: 4797 - protein, 39 aa, synthetic construct
RIRMLKRLLKFLRRSRHQSLRKCDAAVIANRHLPAWRLF

SEQ ID NO: 4798 - protein, 40 aa, synthetic construct
RFKLLSRFLRLYRKLCWKRGANAESLSAACSKKALCLRCA

SEQ ID NO: 4799 - protein, 58 aa, synthetic construct
RFRFFRKFMRLLSTLLIAIDRLERYLMQRMKRNRAYHVRRIMVFAKMKKRPAALLRAP

SEQ ID NO: 4800 - protein, 52 aa, synthetic construct
RFKIYNRMWRRLRHTQFWRRAAKNCLLQFCLKVKIYMLRLRAAALRRMTLYK

SEQ ID NO: 4801 - protein, 41 aa, synthetic construct
LLRWFKKLLKRWRCRDDADLRVMSKKARFWLVYLLYNGRIL

SEQ ID NO: 4802 - protein, 41 aa, synthetic construct
KLRLFRRYLRRFRKHKQRILEMAKRLYNADPASLNLEYWEL

SEQ ID NO: 4803 - protein, 56 aa, synthetic construct
MLRFIKRLMKIFKKVRTASDVTRHCHKVLLRCWALLCRAVLGDARLRPSAASLLAL

SEQ ID NO: 4804 - protein, 57 aa, synthetic construct
LLRFFKKLIRFWKKAARVRAVSRALAFARILSSKRWRLTCPEHETGKIKAHEKIARA

SEQ ID NO: 4805 - protein, 43 aa, synthetic construct
RYRLLKKWLRFLRCQVRMRAGRARATIARKAHTQSFKASHLKL

SEQ ID NO: 4806 - protein, 67 aa, synthetic construct
LLKFLKRLYRFFPCEYLSCALGKQMKTARVRNQIGLLQRMRALRNLREKGKRLNLKKLTCYRVKWKL

SEQ ID NO: 4807 - protein, 33 aa, synthetic construct
KMKLMCRFFKKWPPSLAALLLLKCADNKMSARK

SEQ ID NO: 4808 - protein, 30 aa, synthetic construct
KLKLYNKFFRFYRPRVRKAELAGHFAADKK

SEQ ID NO: 4809 - protein, 42 aa, synthetic construct
FLRWLQRLLRRFCRRKRCRRPDRKEGTVANALPLKEAAEPRA

SEQ ID NO: 4810 - protein, 29 aa, synthetic construct
LFKYYNRILRRLRHRATMLCYYALPRKKQ

SEQ ID NO: 4811 - protein, 59 aa, synthetic construct
FLRILRRMLKRWKCSLNRFDRLSWHDIAAAKRDLKRARAAQECAIRRKRIARLSSNMGY

SEQ ID NO: 4812 - protein, 30 aa, synthetic construct
MFKFYKRLFKRLRSPKLTALNADQLFRKAS

SEQ ID NO: 4813 - protein, 34 aa, synthetic construct
KYRLIQRLMKWLRKMALWPRKAKKYARAATIPLK

SEQ ID NO: 4814 - protein, 27 aa, synthetic construct
RLKLYHKLYKLMTRAKAIEAKAKGFWW

SEQ ID NO: 4815 - protein, 55 aa, synthetic construct
LIKFLKKFIRKFRRWKEDRLSHDGLAMRDTLTANKSAALADLYLKWRRRRSRLAA

SEQ ID NO: 4816 - protein, 38 aa, synthetic construct
WIRYWKKLFRKLQKKHIQAMEAWAATMLLHKKAARCRA

SEQ ID NO: 4817 - protein, 27 aa, synthetic construct
FLRLFRKFIKRFPRTTMATLKAQLCKL

SEQ ID NO: 4818 - protein, 76 aa, synthetic construct
KLRMLCKLWRMIRSLGESLLYGKVFKVARQARQAVQDRLNENKKLLDRLTKWDHAVAAHAPRRKRQFLKLKADLVL

SEQ ID NO: 4819 - protein, 83 aa, synthetic construct
KLKLLRKFWRRFHKWRNARRGAAVLQTSYRVQARMNLQMQCVNMAKKLAKTRAAKGRKARTRTAMCRFMKAGMLAAIAFMAMK

SEQ ID NO: 4820 - protein, 67 aa, synthetic construct
KYRLIRRLLKILRSKAFRLTRDIEVYMRVVLLALPEKTKIKWHRSLVCAAQRRRKDLKLHDLAAQCW

SEQ ID NO: 4821 - protein, 62 aa, synthetic construct
FYKLYRRLMKKFKHAEKLHRKVLKRWAPHATNATNRNRMANKLLKGLRAMAQWAKRAKRGIK

SEQ ID NO: 4822 - protein, 69 aa, synthetic construct
KIRFFKRWLRLFKRRNNALMRMAAFRAADIIGALDARAMAMRLKRRCRRKQASMTIMRSRLILNADVRL

SEQ ID NO: 4823 - protein, 25 aa, synthetic construct
FFRLMRRLMRYMKSLAPLACMEKRK

SEQ ID NO: 4824 - protein, 23 aa, synthetic construct
LLKFLRRFLRRFQHQPAMELKDK

SEQ ID NO: 4825 - protein, 57 aa, synthetic construct
KLKFLKKIIRIIPNMKLREKACGARIALKRKHEVRCALRAAMTLAAKFMPLVKYRAE

SEQ ID NO: 4826 - protein, 47 aa, synthetic construct
KFRLIRRLLRLMKQIVYKLVAQNLLMDDEKWKTRRLLNMAANRACWR

SEQ ID NO: 4827 - protein, 28 aa, synthetic construct
KIKFLRRFFRRLQSMAGTSLLRAFLWAA

SEQ ID NO: 4828 - protein, 76 aa, synthetic construct
KFRLMRRFIRRLKRNFAHRAMKQTCSKALRIYVACDYATAWAFYARGCAAMPCTFAARLARRLEARTLFLKLLLLM

SEQ ID NO: 4829 - protein, 38 aa, synthetic construct
LWKFLRRYLRKIQKIKNECLLALARWKNAFLFARRRCM

SEQ ID NO: 4830 - protein, 59 aa, synthetic construct
RYRLWCKLLKIYCRYDLQNHRDFMLRALAYVHIRSYLLALRHFRLLTAKAQARKLRRYM

SEQ ID NO: 4831 - protein, 43 aa, synthetic construct
RIKLLKRLFRRMPKYAALPLVEWKLNADMGLLKTKMPRLPKGR

SEQ ID NO: 4832 - protein, 43 aa, synthetic construct
WFKLFPRLFKKYRQRFKAHLVSRLKERADARAPERASHKEKSL

SEQ ID NO: 4833 - protein, 21 aa, synthetic construct
LLKLFSKILKYFKRLKLLAER

SEQ ID NO: 4834 - protein, 35 aa, synthetic construct
LLRFFKRLMRRWTRRRLAKYGAYKTANLPARARVC

SEQ ID NO: 4835 - protein, 32 aa, synthetic construct
IMKLLRKYWRRLRRQKKADLLEQLRKMHLAAV

SEQ ID NO: 4836 - protein, 26 aa, synthetic construct
LIKFLRKFMKLWKPLYKKAKGALIDK

SEQ ID NO: 4837 - protein, 61 aa, synthetic construct
LLRLMSRYFKLFRSAKLIIAALRKVMCRRKAPRRVKFAYPNQQCPKLRCYGALQRKRERDA

SEQ ID NO: 4838 - protein, 29 aa, synthetic construct
KLRYFPRLLKKYCCKNALHSSKYARDLIL

SEQ ID NO: 4839 - protein, 61 aa, synthetic construct
RLRMLSRMMRKWKQGWVKAVRGLLVLDDKRKKWWKAAKLRLMARKFGHNNVKLAVRTALTI

SEQ ID NO: 4840 - protein, 35 aa, synthetic construct
KLRLFKKILKWFKHRRRRLNLAPRERGLFQAWAAR

SEQ ID NO: 4841 - protein, 24 aa, synthetic construct
KLKLYRKYYKWLRSTSNKLAWMLR

SEQ ID NO: 4842 - protein, 20 aa, synthetic construct
RLKILKRFLKWLTRNQNLAK

SEQ ID NO: 4843 - protein, 24 aa, synthetic construct
KLRMIQKLYKKLRRFMSFYAAAAW

SEQ ID NO: 4844 - protein, 44 aa, synthetic construct
FLRFYRRLFKKMRSAARVRAMPLATYAYRKLLLPLKRACNCKTK

SEQ ID NO: 4845 - protein, 47 aa, synthetic construct
FFRFWSRWMKRFCCKPLYASIARLLKRRHLTLFTRAKFLLKRKDLKI

SEQ ID NO: 4846 - protein, 40 aa, synthetic construct
KLKIFRRFLKRLKPSRKLLWMELLCKLQCLCYMAVAMAKQ

SEQ ID NO: 4847 - protein, 30 aa, synthetic construct
KWRFMCRWLKRLTRHSAHFLLCLKQKSKAK

SEQ ID NO: 4848 - protein, 50 aa, synthetic construct
LYRILKRLLRKFKQKRAKRIHRLVAKIDLPKMLIANEYILYITEHVKLAL

SEQ ID NO: 4849 - protein, 34 aa, synthetic construct
LLRIFQRLIKRYKKIKGKGADLAKHLLLSPRSWG

SEQ ID NO: 4850 - protein, 47 aa, synthetic construct
RMRFYRRFWRRLRTNDKAATAKKAMRWKIGRLNKGSALKAADLLVAM

SEQ ID NO: 4851 - protein, 49 aa, synthetic construct
KWKLFQRFLKKFKKKKSASELKPAASFASKCAFHSKRLEGLLLFLGKRA

SEQ ID NO: 4852 - protein, 29 aa, synthetic construct
LLRFITRFIKRMKNMPEGKRLAKLLTKEL

SEQ ID NO: 4853 - protein, 34 aa, synthetic construct
RFKMLPRLWKKFRRPCSILKYLVKALQLLKLERN

SEQ ID NO: 4854 - protein, 68 aa, synthetic construct
KMRFFRRLFRKICRKSPARRARWWDIKKRKKFKKAALLKAARLIVPADKNKAKPPHAAAARHHARAAC

SEQ ID NO: 4855 - protein, 26 aa, synthetic construct
IMRFLRRLLKFFSRKLSLRRRRVAAA

SEQ ID NO: 4856 - protein, 31 aa, synthetic construct
YMKFFKKLFKKIKKWTLRRARADLLYSAKSL

SEQ ID NO: 4857 - protein, 32 aa, synthetic construct
WMKILKRYFKMLKSKRLAKYKAAGLCKYMSAR

SEQ ID NO: 4858 - protein, 22 aa, synthetic construct
LLRLIKKYFRRLSRNELAGDAY

SEQ ID NO: 4859 - protein, 40 aa, synthetic construct
WIRLLTRFLRFMRCAKNRYAAPSLAKRLNLPVWARREKLQ

SEQ ID NO: 4860 - protein, 26 aa, synthetic construct
RLRLITKFLKKYSRLCLFAIWAAYRN

SEQ ID NO: 4861 - protein, 80 aa, synthetic construct
MYRLLKKMFKKFPRPRGKDFRLKCLTLRHRLPSFGYGARNQKLGRAPAKHLSRSKRKKVCRKPPLTKRCAAAGLWLKDAT

SEQ ID NO: 4862 - protein, 20 aa, synthetic construct
RLRIFTKLIRRFHSLPAFRA

SEQ ID NO: 4863 - protein, 29 aa, synthetic construct
WIKFFKKIYKLYKRERAWAQALLTLRKFT

SEQ ID NO: 4864 - protein, 31 aa, synthetic construct
YLKLIHKLLKKFHRVVRARFMGASLRDKLAA

SEQ ID NO: 4865 - protein, 70 aa, synthetic construct
LLKLLNKFFKFYHKRRLRLTARVRWVLKAAPRKEGSRCRPQDKAKQRLPCINLVHRQRYRGKKKAYANLE

SEQ ID NO: 4866 - protein, 53 aa, synthetic construct
RFKLLTRLWRIMKKLEQRIRMKAWGRALKNRNSSLHWKDRLHALRANARFKRV

SEQ ID NO: 4867 - protein, 36 aa, synthetic construct
KLKYLKKFMRLLRCAPGKRKDARVIYVHRMAIYLAM

SEQ ID NO: 4868 - protein, 30 aa, synthetic construct
MLKLLKKFYRWLHCGRSRRHIWLQRLTALA

SEQ ID NO: 4869 - protein, 40 aa, synthetic construct
KYKLLKKFYKRIRKTNWAHARKLYQIKELGALLHALWILL

SEQ ID NO: 4870 - protein, 40 aa, synthetic construct
KLRYFKRMMKMIRTRWMKRLKDRPVIYAALALSYLRSLEL

SEQ ID NO: 4871 - protein, 21 aa, synthetic construct
RLKIMPKLLKFFRKLNGCRSA

SEQ ID NO: 4872 - protein, 29 aa, synthetic construct
KLRFLRRFYKWLQQLALLFPRKMRHLMTI

SEQ ID NO: 4873 - protein, 35 aa, synthetic construct
MFRILRKLMKLLKRFNDSGADKRLDRPAFSLRKNL

SEQ ID NO: 4874 - protein, 23 aa, synthetic construct
KLRLLKRMFRLYRQLNKFGQYVA

SEQ ID NO: 4875 - protein, 25 aa, synthetic construct
RFRFMRKIWRLLTHAKLIMAAYAKK

SEQ ID NO: 4876 - protein, 96 aa, synthetic construct
KLKLFPRIWKWIRRLAHAYALAAIAMKALPMRALCLTSFALRKLAPVASKRGRSYLYHRLQANRLYFKRLSALVWRKRQWKTKKVWAAALLKNDER

SEQ ID NO: 4877 - protein, 36 aa, synthetic construct
KLKFLTKFLKKLTKLCKLDLALDVSYAQKRCAAFYN

SEQ ID NO: 4878 - protein, 49 aa, synthetic construct
LFRLMPKWLRRLQNWHAAKRRKLSIEHRNWYLRGLLRAYLAFTWWLEKR

SEQ ID NO: 4879 - protein, 23 aa, synthetic construct
WFRLLRKMLRFFQRFSRRASALQ

SEQ ID NO: 4880 - protein, 28 aa, synthetic construct
FMRMFKKMLKLLKTMKMLEAHLKLLKHR

SEQ ID NO: 4881 - protein, 25 aa, synthetic construct
KLRMLNKFIRWFTTRRHAARLLLRE

SEQ ID NO: 4882 - protein, 47 aa, synthetic construct
IMRLLKRLIRRLNRLAVHKSPNAALKKRLCLFKWQKAKWPTTMSLRA

SEQ ID NO: 4883 - protein, 35 aa, synthetic construct
LIKWMRRMWKRLCKYRLRAAKLKCSLFCYKDVLLA

SEQ ID NO: 4884 - protein, 53 aa, synthetic construct
KWKYFSKWMRKFHPHLSKLALILAAMIVLPKLKRLKELMFPRKRAKYEKKLLK

SEQ ID NO: 4885 - protein, 34 aa, synthetic construct
KYRLLRRLFKMLRRAAAGLKRSKITCPEAGARYN

SEQ ID NO: 4886 - protein, 30 aa, synthetic construct
RFRLYRRIWKRLNKRKLAMGKVAALTMNNL

SEQ ID NO: 4887 - protein, 67 aa, synthetic construct
KLRWWKRMLRLLRKPINEKVAALRKNCWRYYLVHKNRKLARKNKRQWLKYRLMWRLGYMLLLMKKVL

SEQ ID NO: 4888 - protein, 24 aa, synthetic construct
ILKFMRKLYRKFSKRVALVTRLFA

SEQ ID NO: 4889 - protein, 33 aa, synthetic construct
KYRILTRLFKRLRKLAASCIASIYRYFAKTKRT

SEQ ID NO: 4890 - protein, 40 aa, synthetic construct
MLRYFCRLMKRLQRLRPGFILARVKQIRAMQAAAKLCKRT

SEQ ID NO: 4891 - protein, 61 aa, synthetic construct
YLRMYRRLIRKLQKPKRELWAMERVRVTFEVARLWQKLAKCYGLLHLLLLTARLALPGCYK

SEQ ID NO: 4892 - protein, 35 aa, synthetic construct
RLKYLRKFLKKIRRELRILDMAILKEIKTCLLVRA

SEQ ID NO: 4893 - protein, 37 aa, synthetic construct
YYRLLTKYFKLYKKAAAAEARHTLLTKRYKMKAGHAL

SEQ ID NO: 4894 - protein, 45 aa, synthetic construct
RLRLFRKLFKLWRKKSLQRVAKLARGLNLKVWRAWAKLRRWAYHR

SEQ ID NO: 4895 - protein, 61 aa, synthetic construct
KIKWYKKYIRILPKKNERRVRKCARVMAAANALRQLALKNAKKIALGKFYWKASARTRLVY

SEQ ID NO: 4896 - protein, 59 aa, synthetic construct
RIKILQRLFKRLRKLCFALATRCFRRPQTLAMQVLRLLAKHKFYTRAIVAAEDDKKYAR

SEQ ID NO: 4897 - protein, 53 aa, synthetic construct
RIRFMHRLLKFLRKALSYKNCRKRRGHTAKVKEKLIMSSWKKNLVPQAKLLLA

SEQ ID NO: 4898 - protein, 44 aa, synthetic construct
LLRWIQRLYRIYRSKAKKATAHEIKKLDILRKARWLLRGAFCKR

SEQ ID NO: 4899 - protein, 45 aa, synthetic construct
LYKILSRFIRWWSHRLLAIKAALPALRRIRSACTAFEKLARARKH

SEQ ID NO: 4900 - protein, 34 aa, synthetic construct
RFKLLKRLLKYFPHMAAKTAKETQFLKSAIRLMR

SEQ ID NO: 4901 - protein, 25 aa, synthetic construct
YLRLFRRLMRKFKKLGALKGCYARL

SEQ ID NO: 4902 - protein, 28 aa, synthetic construct
ILKFLCRLFRRYHQAKARKKTRSLWLWN

SEQ ID NO: 4903 - protein, 29 aa, synthetic construct
YLRFIKKLLRRFTQWRVFLLACKKRDIMA

SEQ ID NO: 4904 - protein, 38 aa, synthetic construct
YLRIWRKMLRKYKKAYAADLLIRNHKMQWPKLRQIEAA

SEQ ID NO: 4905 - protein, 70 aa, synthetic construct
RIRLFRRFYRRLRQARKMATRLKRIALLKNAGQLPSQKKAARAKLPLALVMRDCHACALNRTRTCMKNGM

SEQ ID NO: 4906 - protein, 24 aa, synthetic construct
KFKLLKKFYRRLKNRPLHAVTVTL

SEQ ID NO: 4907 - protein, 52 aa, synthetic construct
LFKLMKKMMKRLRCCGDAPELCRLRTALMWLRKAKTIKNDFRLCLVRLAYKR

SEQ ID NO: 4908 - protein, 38 aa, synthetic construct
WIKFLRRLLKYLKKLKSIAYFKLPAKWGAIKRIEPHTA

SEQ ID NO: 4909 - protein, 24 aa, synthetic construct
WFRYLRRLFRRLKKKALWFRIILA

SEQ ID NO: 4910 - protein, 68 aa, synthetic construct
KMRLIKKLLKRFRKTRRALLQANLILCGAGALTNLRFNKNKHVLVDRFAQPREIKKATLAAAQHTQAL

SEQ ID NO: 4911 - protein, 43 aa, synthetic construct
KFRFLRKLYRKIHKAICKLKPKAAPEGDHKLAWKAPMGACLRK

SEQ ID NO: 4912 - protein, 32 aa, synthetic construct
LLRLIKRFIRRLKKPGDCKKAIPAPLLPETKR

SEQ ID NO: 4913 - protein, 37 aa, synthetic construct
KFRLLRKMLKMYRRYDHALRARVRRVCSHLLPALMKN

SEQ ID NO: 4914 - protein, 30 aa, synthetic construct
FLRLLQKYYKMLRKKRTNCRIGLFLAYKRA

SEQ ID NO: 4915 - protein, 45 aa, synthetic construct
RLRYLRKLLKILRKHLYMWIHSHLLKKQEIAKNYLLAGHLPKRHP

SEQ ID NO: 4916 - protein, 37 aa, synthetic construct
WMRLIPRLLRWFKCPDVHSRLDKLNQLLLLKAKIRAK

SEQ ID NO: 4917 - protein, 46 aa, synthetic construct
LFRLIRKWLKWMKKKTKLDLLTLTSKWKRSAYPLKAEYARTLLPRR

SEQ ID NO: 4918 - protein, 38 aa, synthetic construct
FLRWLRRLMKKYTRFNIKQKFRKYDLAKELYMAKAVAP

SEQ ID NO: 4919 - protein, 20 aa, synthetic construct
ILKYIKKFFKWLKRPAAATP

SEQ ID NO: 4920 - protein, 87 aa, synthetic construct
LYRLLKRIFRKLRRDLKYKRTFDRRKLKLQRMRDRKRILLNDKSHKVQCNTVLHETLLYKLAYRKALELRLHMATKIPAKQFTQPKH

SEQ ID NO: 4921 - protein, 30 aa, synthetic construct
LMRWFHRLMRLLKHRCKKLLCRILRNFLKG

SEQ ID NO: 4922 - protein, 28 aa, synthetic construct
RYKLWKKIWKLLKTKFRHKLMVDLRLLL

SEQ ID NO: 4923 - protein, 27 aa, synthetic construct
LWKLMQKLFRMYTKVRLIRAAEAKQFL

SEQ ID NO: 4924 - protein, 21 aa, synthetic construct
RLKFLNRMMKKFRQLYKVCLL

SEQ ID NO: 4925 - protein, 96 aa, synthetic construct
FMRFLKRFFRKINSGYLRALAAAEAKPILTHDRNIKRDCLKLANGLKLIREADTRVKLPSVLLWVRCKPAKLAKALAPHLQLQKIRCWKELKKLPL

SEQ ID NO: 4926 - protein, 43 aa, synthetic construct
IFKWLKRYLRRLRHYAGSRMRAKLRIMLKPSTFNLHKNRRAAT

SEQ ID NO: 4927 - protein, 33 aa, synthetic construct
KLKWWPKFLRKYKKAWERAHRALRPQALMPLQR

SEQ ID NO: 4928 - protein, 78 aa, synthetic construct
RYKFWSKLYKLFRRRLALAKRKQLYGQATFPAAGTALYKHRKIRQRKGKLRAFYALAYRDRRDGRANAKSQAACALKP

SEQ ID NO: 4929 - protein, 25 aa, synthetic construct
KIKLLSKLLKLIRRQGDLRNLLNKN

SEQ ID NO: 4930 - protein, 36 aa, synthetic construct
KLRLWKRMLKRLRRFTCKKLDVSMAYMLVLRLQKTE

SEQ ID NO: 4931 - protein, 63 aa, synthetic construct
RWRYLKKLFKKLPNLRRCKRLRLACIDHLLRRSARRFRQAKFRNPRLQWKMQFVCEALDVLGR

SEQ ID NO: 4932 - protein, 23 aa, synthetic construct
FLRYYRRMMRFLTKKLTLERDAL

SEQ ID NO: 4933 - protein, 89 aa, synthetic construct
KLRIFRRLIRLFRRRGQRLHADLTKLSGPDAAQCMAPIRAAKRCQLLKWAIRLKQWRPGKKCLWLTPFARRHALAVRPRRLHSKGKAKL

SEQ ID NO: 4934 - protein, 56 aa, synthetic construct
WLRLIRRYLRLWKRKAVKVRFHLSTPWPALDKTTTARLATRRKDEAKTVLRSLAKR

SEQ ID NO: 4935 - protein, 25 aa, synthetic construct
LLRLWRRFYRRWQHTVLKLRRSALL

SEQ ID NO: 4936 - protein, 51 aa, synthetic construct
RFKIFRRYFRLFHRAALLKKLYVKRVLRAAYKLLMTRWKLDVVLLGWGLAK

SEQ ID NO: 4937 - protein, 45 aa, synthetic construct
RMRMFKKILKKFKKRLLLKAYDLYLWLDAHCEKRCHAYTLTFKAK

SEQ ID NO: 4938 - protein, 34 aa, synthetic construct
RLKWLTRILRRLKTDISAREANCIHAALRWEAQR

SEQ ID NO: 4939 - protein, 79 aa, synthetic construct
KYKFLKRIYRIIKPKMMRLFALGALQGARILANLASALRAEGFNICKRHALRYLKKRRLGRLRRLFNHRRHDKRKLDCQ

SEQ ID NO: 4940 - protein, 62 aa, synthetic construct
FYKMMRKLFKLLCKKFAKKLKRRKIIMAWAPHAHSRNRMKAFKNESRQAAFAQLYCALRALF

SEQ ID NO: 4941 - protein, 65 aa, synthetic construct
FWRMLKRYLRKFRTKKPKYSLLALSPMKKLLENCAKGGYALCLSKMKPFLDHDRLRKADLSARRV

SEQ ID NO: 4942 - protein, 70 aa, synthetic construct
FFRFMNRMWRKFKNKWFLVKLRKKILEARMRVALKKRHRLAWKLCKYHKLARQANAELGKTKLFNKADPV

SEQ ID NO: 4943 - protein, 95 aa, synthetic construct
RLRLFKKWLRYMKKVAGGRKWVKTDKLFLKKPYKQRLALRFRCCLKNRAPAGYDWGTRAKLAKTVAWADVRQAKGLLTRFEKLRAKQWNLDKKAR

SEQ ID NO: 4944 - protein, 37 aa, synthetic construct
KYKILRKLFRKYRSLLQASQHALRLRMAAVFKQLLQR

SEQ ID NO: 4945 - protein, 29 aa, synthetic construct
LLKLWKKFFKRMTKLAIRSALKYIALRKY

SEQ ID NO: 4946 - protein, 31 aa, synthetic construct
RFRYLNKLIRRLHRRTADKMLAVCHPLSLAR

SEQ ID NO: 4947 - protein, 27 aa, synthetic construct
LLKLLKRYFRLMCKHNLKAWLYHRAGT

SEQ ID NO: 4948 - protein, 49 aa, synthetic construct
LWRLFQRLMKLFKSSNLALLWRPFLRLKKMDRHKAARKAMQYKDSASYS

SEQ ID NO: 4949 - protein, 60 aa, synthetic construct
MLKMFRKFIKKMKSFAAYAKAHRHLKKAAKADGRLGKPLKHHTADRLLKMVQRTDLRMLC

SEQ ID NO: 4950 - protein, 31 aa, synthetic construct
RFKLWRKLMRRLTRKSAMRLELIAPKATVAA

SEQ ID NO: 4951 - protein, 47 aa, synthetic construct
MYRLIKRLLKMLCKRGRSMRSLYLAKHLNCAACAAGALCFQDHKLDK

SEQ ID NO: 4952 - protein, 40 aa, synthetic construct
RYKLLCKLLRLWKCTQKLLTKARRYLPLEKCHLTKYPMIG

SEQ ID NO: 4953 - protein, 54 aa, synthetic construct
KWKLWKKYWRIFKCWNHLRLYRMQYPTKAFRCPARALDKKRAKARKPLIQARAL

SEQ ID NO: 4954 - protein, 35 aa, synthetic construct
KFRFLRKILKLLKKLAPLAKRSLKPFTAYFNYQAC

SEQ ID NO: 4955 - protein, 45 aa, synthetic construct
MLKFLHRLLKFLRQLAVQCISLYCKMKLDDARVAPKSPRLRRKVA

SEQ ID NO: 4956 - protein, 29 aa, synthetic construct
FLKLLKKFFRRLKTRKPPAQLPKVRAHDL

SEQ ID NO: 4957 - protein, 71 aa, synthetic construct
RLKILHRLFKKLRQRMRNQRSSLADDQLFLSAKEQLYKRWIGADLLTMRAARPPKRAKARQEARRRIGRWR

SEQ ID NO: 4958 - protein, 27 aa, synthetic construct
FLRLLRKFFRMYRSALKTRLSVFRARM

SEQ ID NO: 4959 - protein, 33 aa, synthetic construct
FMRMLSRLFRKLNQQARKRDKGCLAKIRFADKL

SEQ ID NO: 4960 - protein, 50 aa, synthetic construct
RMKLWPKLFRRMKRKRIKLTLIWLRHLKCKSSGLLKARVKSQLNALLVQS

SEQ ID NO: 4961 - protein, 54 aa, synthetic construct
KYKYLNKLLKKMCPIANRFAAAGNHVFLRNSLDTLKAKSHKMLAGLRAKILFKK

SEQ ID NO: 4962 - protein, 22 aa, synthetic construct
LLRLLHRLMRYLNKKVFAHCDR

SEQ ID NO: 4963 - protein, 89 aa, synthetic construct
LFRFWKKIFRRFRTRLWFSLWWALSAVRKNSLNENKPLAKRKLALWDQKKKCIKKTILRYYKRADLATALLLRSYNQKHMNKKRGPAAL

SEQ ID NO: 4964 - protein, 96 aa, synthetic construct
KLKFLKRFFRRIKRKGIAYLIALLPRKMKPVQMMKAAALARLEKCAREFKKRLRRKACKKWLRHAPAFAFFRSAGWPKTKPFAKRLNWSAEKFEEC

SEQ ID NO: 4965 - protein, 62 aa, synthetic construct
KLKFIRRILKRWRKCATYALKRRRARLPWDRLGACDCVYNNLDLHRKLRRECLRKCVKLLWN

SEQ ID NO: 4966 - protein, 20 aa, synthetic construct
IMKFFRKLFKKLRSFLAPAT

SEQ ID NO: 4967 - protein, 76 aa, synthetic construct
LIKLIPKILRRLRHEKQKALVKHYRQCLNDAARAHYLRLTKLKVWRLKGKRLAKADNKMMLYLANLSKAKLIGKKR

SEQ ID NO: 4968 - protein, 53 aa, synthetic construct
KFRFMKRLFKRWKKLMMKNAVMLAHRLLAAACNLRYRLTVDCVRFAAADQARM

SEQ ID NO: 4969 - protein, 39 aa, synthetic construct
KLRLLRRLYKRFKKKHSMRRTAKVEAAYVWSALAWHFNS

SEQ ID NO: 4970 - protein, 33 aa, synthetic construct
KWRLFRRMMRLLRSLQANCLRWKAVMALQLMQA

SEQ ID NO: 4971 - protein, 32 aa, synthetic construct
KLKMIRRLLRYLRHKPRTVLLAVCPPLAEIVK

SEQ ID NO: 4972 - protein, 47 aa, synthetic construct
YLKYLRRFFKKLKHMKRRNAVLRAKEKADVLANGREMKLLAVQLNIF

SEQ ID NO: 4973 - protein, 80 aa, synthetic construct
LLRWFSKFFRIIQPKNRAGRRGRHLLKKLQKMACACAKQKKRKDALLAYVQHCLAKGSVRLKRWLEKTDYCLAGKRTAHA

SEQ ID NO: 4974 - protein, 53 aa, synthetic construct
RIKLMRRWMRMWSRRNMRCWRENKWDLLLARLLAAKKLKLNLAKCYQIKCMKR

SEQ ID NO: 4975 - protein, 31 aa, synthetic construct
YMKLLKKIYKRMKRTRLAALNLIDARMALPI

SEQ ID NO: 4976 - protein, 29 aa, synthetic construct
KWRFIKKLLKKMKKLVAEKLALVPRFAVE

SEQ ID NO: 4977 - protein, 47 aa, synthetic construct
KFKLLCRLMKKLKHRKHACRANRQKGLQGDLYWLYRKQKGLKMLAIA

SEQ ID NO: 4978 - protein, 31 aa, synthetic construct
FLRLIRKLLKKLKRFDFKTANAKAPMRMIIP

SEQ ID NO: 4979 - protein, 52 aa, synthetic construct
KFKMLKRLYKKYKSKMLAARRSYGTLHSAAFARQVSYLKHDYHKRWKKLHLR

SEQ ID NO: 4980 - protein, 92 aa, synthetic construct
KLRLLNKLLKRIRTIMRRCLAFKAVSAKKMVGDRYSYAAILNYLKEEPPVAGVKYAKRKPRALCSRVLLKAMHFCFGKLLQKKEKKYKVALK

SEQ ID NO: 4981 - protein, 94 aa, synthetic construct
FLKLIHRMLKYLRRERRSMRKYRWRILNLMLVAALQMKILLATLLADKKFGFDDKMRFLALTKIAKHRRIRSRKWRVKYCHFRNNKRLATLALP

SEQ ID NO: 4982 - protein, 36 aa, synthetic construct
RFKFMQRLLRKFCHLARRAVPPADAKTAYKCLGAKL

SEQ ID NO: 4983 - protein, 74 aa, synthetic construct
MLRMLKRMLRRLRKIEACAARRLCKSKLYGKRANYSATKLIVKRAKQLLMLLELFVYHGRKLKWSKTRASKPYK

SEQ ID NO: 4984 - protein, 33 aa, synthetic construct
RWKMYKKYYRRMKRGLDGLATTADIKLALRLLR

SEQ ID NO: 4985 - protein, 38 aa, synthetic construct
LLKLMQRFLRRYPSLRFAAARWDRANKTITRLWRASRW

SEQ ID NO: 4986 - protein, 59 aa, synthetic construct
RIKFLTKLLRKLKQGAAKQCDYLSWKDRWTRYRCKACLLIYLERARKLGAAFHALFVCK

SEQ ID NO: 4987 - protein, 35 aa, synthetic construct
WIRFYKKLYRRWHTLKRLAAAIRALLWKAHTKQKC

SEQ ID NO: 4988 - protein, 41 aa, synthetic construct
RFKLFPKLLKLLKQAPLKALARWITVLLKRKAKLEPAVPGN

SEQ ID NO: 4989 - protein, 40 aa, synthetic construct
RFKFLRKMIRLMPSAKLRRLLDTFAKLSERAWHSGRKLAL

SEQ ID NO: 4990 - protein, 28 aa, synthetic construct
RLKFYRRMMRLIRRAMLALWKTRAQFAV

SEQ ID NO: 4991 - protein, 20 aa, synthetic construct
RWRLLSRLWKRYRKMAIANQ

SEQ ID NO: 4992 - protein, 21 aa, synthetic construct
RFRWFRRWMRKFRKLLLTLAA

SEQ ID NO: 4993 - protein, 51 aa, synthetic construct
KLRYLKRLIRWIRRLATMFLLAVPYDGKDRSKEIRWDEALAARRQKATAFK

SEQ ID NO: 4994 - protein, 58 aa, synthetic construct
RIRLWRRIYRLFKRRMFATANAVHAPRRPLRLQLARAAPVVWTARLNMRKAWRPANDP

SEQ ID NO: 4995 - protein, 58 aa, synthetic construct
MLRFLHRFIKKINKKLRLRHWAEPMAKRKWGMAARWNLKLAAMKELPVALLTKRVKKK

SEQ ID NO: 4996 - protein, 44 aa, synthetic construct
KMRMWRKILRKFNKRMKYLLSQKIILLLRLKRGLHDAASLEPMR

SEQ ID NO: 4997 - protein, 65 aa, synthetic construct
RLKLLPKLWRKFNHGKGYILLQYRAKAARKLAFVNTSRFRRRQAFNIAQKAPALRRENDARRDAW

SEQ ID NO: 4998 - protein, 62 aa, synthetic construct
RLKIFRKIMRLFKRPRRLLKYLCFCIDIKLASMKALDGHDLAAARGTRLEKAWKAILVFERR

SEQ ID NO: 4999 - protein, 22 aa, synthetic construct
KLRWFKRYLRIIHQRAACATKL

SEQ ID NO: 5000 - protein, 29 aa, synthetic construct
RLRWWCKFLKYLQTFMGKALAHRALATKN

SEQ ID NO: 5001 - protein, 25 aa, synthetic construct
KLKWLKRFLKKYKNEALMWKLTCLF

SEQ ID NO: 5002 - protein, 21 aa, synthetic construct
LYRLLRKFWKLLQKIQRCIKA

SEQ ID NO: 5003 - protein, 26 aa, synthetic construct
FLKYWNRIWRFLKRALAHEKHLCRKL

SEQ ID NO: 5004 - protein, 20 aa, synthetic construct
FMRLWQRLLRLFRHALYSLR

SEQ ID NO: 5005 - protein, 73 aa, synthetic construct
RFRWLKRLLRRFKCLDATNRKRGKQATPFQLPRSQAAAQFACCILLPKSRDLKKKNKRLARVAKYLQTHRKMA

SEQ ID NO: 5006 - protein, 49 aa, synthetic construct
RFKFFRRMFKLWKRLAALAKKLKALALLGRRIKAFRVGKCHRGGAQHLF

SEQ ID NO: 5007 - protein, 27 aa, synthetic construct
RLRFLTRLFKRWKTPAAACRAKHLKTR

SEQ ID NO: 5008 - protein, 25 aa, synthetic construct
LMKFYKRMFKIYRKAFAKKADLGVA

SEQ ID NO: 5009 - protein, 40 aa, synthetic construct
YYRFLSKLWKKLRRWTLRRRGQGLNDQLANARVVAKFRKN

SEQ ID NO: 5010 - protein, 25 aa, synthetic construct
RFKILRRLWKFMRRAAALPKHGRLM

SEQ ID NO: 5011 - protein, 36 aa, synthetic construct
MFRLLSKIIRWFHKARRAHLLASTRFAVKAGRNRLY

SEQ ID NO: 5012 - protein, 33 aa, synthetic construct
KFKLLQRIIRKYRRGWGVPAARALYRSGLATLL

SEQ ID NO: 5013 - protein, 48 aa, synthetic construct
KWKLIKKLLKYLQKSGWFRRTHKATAFLGRMRISWARVARLQRRKFLA

SEQ ID NO: 5014 - protein, 37 aa, synthetic construct
KLRLFKRYMRLWRKLNVNHEACAQAWAKKELFRAKEC

SEQ ID NO: 5015 - protein, 26 aa, synthetic construct
LLRLFRKWYRFLNNKRRHLARNLFDA

SEQ ID NO: 5016 - protein, 68 aa, synthetic construct
KWKWLKKILRKFKSAMDKAEWCLNSGAKQNTIMAFLRMKKRTKFCANGRHVRVQARALADRALRAAKA

SEQ ID NO: 5017 - protein, 53 aa, synthetic construct
IYKFFNRLIKFYRRKLNLPKAGPAERANAKRLRTKRALCVYKYKKKPAAYNRL

SEQ ID NO: 5018 - protein, 53 aa, synthetic construct
RFRYLKRLLRKFKQLHRRLLIPQLQWLWYLLLTAKPLNRSGAFKPALLEKVLQ

SEQ ID NO: 5019 - protein, 41 aa, synthetic construct
LLRFWKKYFKLLHPAELCQRALYRALRAVASKLLVINKKRE

SEQ ID NO: 5020 - protein, 70 aa, synthetic construct
RLKWYSRYFRKFKRLKRILIAKLQNRTHYLPARKKWARATKLLGARADGYDEDLALIANDNRAAERQRVS

SEQ ID NO: 5021 - protein, 32 aa, synthetic construct
FFKILTRYWKLMKKLLKAKSAKREYIKNANAV

SEQ ID NO: 5022 - protein, 81 aa, synthetic construct
LLRLIKRIYKKLHRKLFMLRLARQWRRTPWWVLIDFLLVVWRRRKLRLAGHRKKHAMRKVFDSLEAKYIAQNKYRNQKAIA

SEQ ID NO: 5023 - protein, 33 aa, synthetic construct
LFKILKRFYRWLKKLHYLLEGDPRLARLRQIKG

SEQ ID NO: 5024 - protein, 55 aa, synthetic construct
KLKYLSRLFRRLKRRLRAKLRNKMAYASRAFNAKGWLILHQRLNANVLLQKEKKK

SEQ ID NO: 5025 - protein, 38 aa, synthetic construct
RIKLLRRLFRWWPKIETYNAAHRKYWHAKKLESLAKCA

SEQ ID NO: 5026 - protein, 40 aa, synthetic construct
KIRYYRRLLRRWCSRVAALLMDLSMDRMKAAWACLLLRLE

SEQ ID NO: 5027 - protein, 55 aa, synthetic construct
KWRFLRKLYRLLRNNLANALNRRFGFKSDRIKMWALKKIRLMVFGKGKQAAPGRL

SEQ ID NO: 5028 - protein, 60 aa, synthetic construct
KIKYFRRYIKLFNRLKAKVDLFKILALYRLRKQFALSALQNLRWKELFSDICLQAAPRCL

SEQ ID NO: 5029 - protein, 56 aa, synthetic construct
KLKFLRRFFRKFKRLLQKRAYRWIAKALKALVHLFARLERACVELYASEAATWKDK

SEQ ID NO: 5030 - protein, 40 aa, synthetic construct
IFKFWRKILKFLKKAAHALRGEKAAKVQRMRKQLAWSRDG

SEQ ID NO: 5031 - protein, 74 aa, synthetic construct
LMKMYKKYLRLYKKGLAPSLKVAERMRKRQFQKSLHHANARSLKCLFRLAANKTWAKVKDLRKLGKKHLYCLAT

SEQ ID NO: 5032 - protein, 20 aa, synthetic construct
KWRYLKKYWKWLRHLGQKAL

SEQ ID NO: 5033 - protein, 31 aa, synthetic construct
LYKLFSKLFRKMRKLRVEALAFRRKMACDKM

SEQ ID NO: 5034 - protein, 42 aa, synthetic construct
KFKLWRRYLKKLSKKMLSLHMKKAHLRYHWKCLIRYETMALR

SEQ ID NO: 5035 - protein, 55 aa, synthetic construct
LWRYLRKLMKFLKNANKKKDLCMAKKIAHCHHKCGTNLWGLKRALKRRLKLCVWD

SEQ ID NO: 5036 - protein, 50 aa, synthetic construct
RIRYYCRLLKLWKKAARAISCRNWRQCRNRHGKRHVAKAWAAANWAADKR

SEQ ID NO: 5037 - protein, 40 aa, synthetic construct
LIRFMKKWYRRYRKRRALKCLRARLLMVITSPWDAKAATF

SEQ ID NO: 5038 - protein, 60 aa, synthetic construct
FYRFFKKYMKRIKRFKLCLFALLRDLRRSIARLARFAIARVKYGALAKTKWKSKQWLRLW

SEQ ID NO: 5039 - protein, 46 aa, synthetic construct
FFRLIRKIFKRLNKPTRKRKCLSATTYPRAYAKKHALAVTLLRAIL

SEQ ID NO: 5040 - protein, 32 aa, synthetic construct
YLRLYKKWWKIMPRHLDGAVAAKAWKYPLKKR

SEQ ID NO: 5041 - protein, 83 aa, synthetic construct
KIKWLCRILKKMKTRFRELFELFQALAHMLDKAHKLASNRGTPICKKRSIRQMLKGLSLLLRAADQLWRRIWVLLHKRDKKAA

SEQ ID NO: 5042 - protein, 40 aa, synthetic construct
KLKLLKKFLRFYQQLAAKAWKKQERLKASNVLARAHRDQR

SEQ ID NO: 5043 - protein, 20 aa, synthetic construct
LIRLLNKWYKKFKCVLAKKS

SEQ ID NO: 5044 - protein, 56 aa, synthetic construct
LYRLFHKLFKRLTKLKRDLNKAQRLFETLWNAAAIHDKAKLKYKAWKAIAVFMIDS

SEQ ID NO: 5045 - protein, 71 aa, synthetic construct
IYRLYRRFYKLLKHLPRAKAAQARMALPKLVRAPSQEKSPATKFWCKASATLERQHAKRLSSPRLKLCIKA

SEQ ID NO: 5046 - protein, 43 aa, synthetic construct
LIRYMRKLLKYLPCCKGRGDLNRSKFLFAMTLKCRAKLAGWRK

SEQ ID NO: 5047 - protein, 48 aa, synthetic construct
YYRLYQKLWRRLRKAHRELEWKYTRHAKPAALAERKNPRAKCLAAGNW

SEQ ID NO: 5048 - protein, 64 aa, synthetic construct
LFRLFCKFLRKFKTRADLRKKQKAAVKRHCPLAKARAAFLVIDDRRWRLIYRLRKTLTGARLLR

SEQ ID NO: 5049 - protein, 23 aa, synthetic construct
LMRLLKRYMRLIRRNSPAARRDM

SEQ ID NO: 5050 - protein, 36 aa, synthetic construct
RLKLYSRLLRYLPKKAPPLRKQLYRISRCHSMYRLG

SEQ ID NO: 5051 - protein, 58 aa, synthetic construct
RFRLLKRFLKYLCQYARKLTRWYYKNWDWKLKALCVKRLCVFANKSAAQLKKLWYTQA

SEQ ID NO: 5052 - protein, 28 aa, synthetic construct
WFKILRRLLRRFKCKAPIPNLLKLRMAA

SEQ ID NO: 5053 - protein, 25 aa, synthetic construct
LIRLWHKLFRRLKCANVPRTAKVLM

SEQ ID NO: 5054 - protein, 69 aa, synthetic construct
LIRIWKRLWKKYQHHAAINKLRAKRRRSWLVRLFKYLLVALKKLRLEVAKRTLKERHIDLSLLLFTTYH

SEQ ID NO: 5055 - protein, 34 aa, synthetic construct
FLRWLKRIFRKLKQICGMALRKARQRTCNPLEAK

SEQ ID NO: 5056 - protein, 60 aa, synthetic construct
KFRMFHRLMRMFKQKKRMLKLLGQIKQVNRVVRALAVTEERKAFLDRRAVAVLRQRAKAR

SEQ ID NO: 5057 - protein, 80 aa, synthetic construct
KWKIMKRIMKKIPSLAATNAAAFKCLSLLYRAKYWALARLVGQRPLRPATYYLLPWLHEKDRDRLWLPAHLRKKHLATAR

SEQ ID NO: 5058 - protein, 20 aa, synthetic construct
LYRLLHRILKKWKKYHARST

SEQ ID NO: 5059 - protein, 20 aa, synthetic construct
RLKYYRRLFKFLQRAPCALL

SEQ ID NO: 5060 - protein, 22 aa, synthetic construct
RLKFYKRILKKLKSAAGDFAFL

SEQ ID NO: 5061 - protein, 21 aa, synthetic construct
LWKYLSRIYKKLKKKTARLPA

SEQ ID NO: 5062 - protein, 40 aa, synthetic construct
LWKLWRKLMRKFPHQCAYDRKAHAAGKWAKAKAQRNVAHM

SEQ ID NO: 5063 - protein, 24 aa, synthetic construct
LLRFLRKFYKFLKKQTVMALRTKM

SEQ ID NO: 5064 - protein, 29 aa, synthetic construct
FFKMLRRMLKRWTKQAFARRVAALRLKAH

SEQ ID NO: 5065 - protein, 63 aa, synthetic construct
LFKFIRRIYRRFRRLWLLRYMGGYCVTAAPALRRRTAGLCRRRRDRMARPKKRDCLCLPDACA

SEQ ID NO: 5066 - protein, 24 aa, synthetic construct
KWKMFHKLLRLLTRKWHAKLNHAN

SEQ ID NO: 5067 - protein, 28 aa, synthetic construct
MLRYFNKFYKLMRRAARCRLLRLTYSQK

SEQ ID NO: 5068 - protein, 48 aa, synthetic construct
RFRFLRRLMKWFCRTLNNKRGNLLRQKPKAFALCAKLLKRQFPAAREK

SEQ ID NO: 5069 - protein, 20 aa, synthetic construct
KFKFWPRLYKKWCKAAATFA

SEQ ID NO: 5070 - protein, 53 aa, synthetic construct
ILRMINKLIRLWRRMSLARDFRLNARVLVAACNAKILGAAHILLQGKKGKLAK

SEQ ID NO: 5071 - protein, 62 aa, synthetic construct
WIKWIKKFLKKMKKNKALLGKRRKLLAVNILRDKAAALVRRYAAASHLCQKAKYRWDPQLRV

SEQ ID NO: 5072 - protein, 44 aa, synthetic construct
KLKLMKRFFRKFSRLKQKIPRAEDLALNMLFLFDAQALKRTLWT

SEQ ID NO: 5073 - protein, 95 aa, synthetic construct
KFKFWKKLYKKLKRMLPWLPAAGHNEKVRLDHPFSFKLLLKARETIEDRGKKLMLWTKLYRASRYAPALCKRYRLGRCRKYTAATQAFSKAKLAL

SEQ ID NO: 5074 - protein, 49 aa, synthetic construct
KLRWYKKMFRLLTPARHYKLLALLEAYMAAHLSKKRSNRCYGLKCNLKR

SEQ ID NO: 5075 - protein, 38 aa, synthetic construct
LLKFYKRLFKKIRPKTVLLQALYLDCALMHRRAKDATC

SEQ ID NO: 5076 - protein, 29 aa, synthetic construct
ILRWYTRYLRWWRKKHAATMLKKKELHCL

SEQ ID NO: 5077 - protein, 83 aa, synthetic construct
LLRIFKKLYRKLNKCRCYSAAILILKIKALKRRFLRHKLLGEIAVRKCEKAPCVVHKRVWNLFDCESVEKKAYRAEAPLRLKR

SEQ ID NO: 5078 - protein, 20 aa, synthetic construct
RLKMMKKLFRFLNRMGLLQR

SEQ ID NO: 5079 - protein, 49 aa, synthetic construct
RFKMMQKLIKMYPKATWGRVKSKRALRLPADADKKPLMAQPKAARKKLQ

SEQ ID NO: 5080 - protein, 36 aa, synthetic construct
LIRFLHRFLRRMPKKTLGKLKSLKSMTKKNLILGEL

SEQ ID NO: 5081 - protein, 27 aa, synthetic construct
LLKWMRKLMRLLTKNFCPLCARYRQKG

SEQ ID NO: 5082 - protein, 35 aa, synthetic construct
KMRWYKRMWKRIRRALLGAPKRLALALPMRENAIQ

SEQ ID NO: 5083 - protein, 34 aa, synthetic construct
FFKYLKKLLRKMKCQLAKLKHAWGGKRTLRQPFV

SEQ ID NO: 5084 - protein, 56 aa, synthetic construct
KLRLMRRLIKYLRRDAGKLMIKAHRKGWLAIRADWKCLWKLCVDRWAQRKMQYHAR

SEQ ID NO: 5085 - protein, 27 aa, synthetic construct
LYRLIKRIIRRLNSYLRALCIKVKASN

SEQ ID NO: 5086 - protein, 40 aa, synthetic construct
RYKWFCRLWKYIRKRLNAFSLLALRLRQPGLVSAFGQLRA

SEQ ID NO: 5087 - protein, 49 aa, synthetic construct
IMKLLSRWFKLLPSRPQLWGLEKHRILRLKELRRKLAKLARREKNSRDI

SEQ ID NO: 5088 - protein, 35 aa, synthetic construct
KLKLLQRFLKKWKHYTDLLLSHLLYKKPQKRRSGW

SEQ ID NO: 5089 - protein, 52 aa, synthetic construct
MFKWFKKLLRKYQRLTLKNKSAAAKYNLFRRRRCKRCLTRSACAMWMQKISL

SEQ ID NO: 5090 - protein, 33 aa, synthetic construct
LMKWLRKYLKLLSRMSAKANSRKILVKKELNKL

SEQ ID NO: 5091 - protein, 34 aa, synthetic construct
MMRYYRKWIKLIPPLRMKKANRLARAVALYQWAK

SEQ ID NO: 5092 - protein, 24 aa, synthetic construct
LLKLYRKWMKKLHKKCASARFAII

SEQ ID NO: 5093 - protein, 47 aa, synthetic construct
RLKFYTRMLRLLSRTRDTSFRNKGRAHRRAVLMQIRLRRWTAAKVMA

SEQ ID NO: 5094 - protein, 34 aa, synthetic construct
KLKWFRRFLKIYRRTCLDFLYCPADKRKALLVQK

SEQ ID NO: 5095 - protein, 85 aa, synthetic construct
FLRLLKKFLKKFSCNAAEANRKPNLRMHPAWYRRCAALRGKWAMRAAEYGNSRDWAAGLFKRKRLILRKEELKIRIALIAKEMCV

SEQ ID NO: 5096 - protein, 29 aa, synthetic construct
FMRYLHRFWKKLQRLRRLKRQFPNANLEA

SEQ ID NO: 5097 - protein, 75 aa, synthetic construct
RMRWLSRFLKMWPQLILKKRRRIFYGATMVMARLKKLIKKHKCWRAAVRLKARAPPLIKHAARKGAKQVGMIAWK

SEQ ID NO: 5098 - protein, 21 aa, synthetic construct
KLRFFKRYFKLLPRKQMWLCA

SEQ ID NO: 5099 - protein, 31 aa, synthetic construct
KYKYWSRLLRKLRHKKLIYLRHAEARANDYL

SEQ ID NO: 5100 - protein, 34 aa, synthetic construct
RLKYLKRMFKLYRKRYPVDRLELPAASCLHKEAY

SEQ ID NO: 5101 - protein, 29 aa, synthetic construct
RLKWFKRLMRLISNPLLAAIIRRRHNAPY

SEQ ID NO: 5102 - protein, 67 aa, synthetic construct
KLRLWKKLLRKYRKRNTRYAWSLLKASEAAVLRLPPYWYQRCRKPLVGKQKAKSEAHRHAARDEWGR

SEQ ID NO: 5103 - protein, 74 aa, synthetic construct
KLRFLPKFFKLWKKLWAKRNLALATGFWVASKQNKKRQRLEAAKLKDDHKKAQLGKIKNKSNEMLLRSKLPKTR

SEQ ID NO: 5104 - protein, 40 aa, synthetic construct
RMKLWRRIWKKYRSAKAARHRAQAKMLVCPLLQKKPLYVC

SEQ ID NO: 5105 - protein, 23 aa, synthetic construct
RFKFMTRLIKYIKRLLKLLYKAH

SEQ ID NO: 5106 - protein, 38 aa, synthetic construct
KLRLLHKLLRKFCCKDAAQLKARMPDKLIAMVTWLLRC

SEQ ID NO: 5107 - protein, 37 aa, synthetic construct
MIRFYKKLLRLYKRAAFRIFKLAIKKVQRMALTLDPF

SEQ ID NO: 5108 - protein, 39 aa, synthetic construct
FFKIMHKLLRRLRRARPNKRKLAHPAALCAQIFFFDCKA

SEQ ID NO: 5109 - protein, 69 aa, synthetic construct
KIRWIQKLFRRLRSLLRAAQTRSLFKYRFDLRPTSERRCNLLNAKMLGKQAAEFAKLAERAFGPAEGLA

SEQ ID NO: 5110 - protein, 51 aa, synthetic construct
RLKLISKMLRYWRQVLAKKFKKLTLKLRDLIQRVAYLQRDSLLKNLRVAMT

SEQ ID NO: 5111 - protein, 41 aa, synthetic construct
YMRLLQKMMKFFKKPRVLAADDRLKSPAATALSKNYTLAKR

SEQ ID NO: 5112 - protein, 32 aa, synthetic construct
MLRLMRKLLRKYRKLKPICTAHKLCLVANKRR

SEQ ID NO: 5113 - protein, 62 aa, synthetic construct
MYRFYKKILRKYRNAIWKKAYAAFRAAKDPMRRRKEAEPLPISLNLKKRRACHKNAAELAYR

SEQ ID NO: 5114 - protein, 33 aa, synthetic construct
LLRYFHRYIKKLKSALVRRANRRNKLPAIVRKL

SEQ ID NO: 5115 - protein, 28 aa, synthetic construct
ILRYLRRWLRKLTKIPKDNKAGAAIKFA

SEQ ID NO: 5116 - protein, 25 aa, synthetic construct
KLRYLTKLLRMLKKKMLYSLVKVSR

SEQ ID NO: 5117 - protein, 68 aa, synthetic construct
RWKWLKRMYKKLRNRAPLEPTTVLKKSRLPRADRAALLRQRTARGKDSPAWLMSSFFLRKRAKPFWFL

SEQ ID NO: 5118 - protein, 93 aa, synthetic construct
KFKIFKKWLKKIKKLHALRLRAVTRRLAALFECARKAAVKDLAHTFKQWAISLPMCSKAKWYLGKPLLYEKAMMLAFTRVRLARLNIELFDDR

SEQ ID NO: 5119 - protein, 43 aa, synthetic construct
IMRFFKKWFKKFRQALRWRAHAKRCLVLLKASRQTATHLKKGA

SEQ ID NO: 5120 - protein, 39 aa, synthetic construct
IIKYLRKMMRRLRRLKLLFKRKTKAELSLCHLPRAWATK

SEQ ID NO: 5121 - protein, 51 aa, synthetic construct
KFRLWTRYLKYLTRLKAAMLALSAKICKAAWKRRVRRAARTRLRKYWKNKA

SEQ ID NO: 5122 - protein, 69 aa, synthetic construct
RIRIIKRFLKKWRKLRAHSCPMSCGWACALRLKRRAWDTFKNLWFLRDLTKALRVKLRRAIWWGALAAS

SEQ ID NO: 5123 - protein, 35 aa, synthetic construct
ILRFLRKWLKRFTCHFRAKLLRKALLGAKRRIDQA

SEQ ID NO: 5124 - protein, 40 aa, synthetic construct
RIRWMNRLLKRIRRAQCFVKAAYWRYLLKRVWKAMAWSKC

SEQ ID NO: 5125 - protein, 85 aa, synthetic construct
KLKLMKKLLKRIKRNFRRKLAQASLHALEHWIDLLKPRRLSDLDPYAISTKAKIARMKAQYYTGKCAVTAARWAKTPLMLLRFFC

SEQ ID NO: 5126 - protein, 20 aa, synthetic construct
YLKMLTKLFRRFKTARYPRA

SEQ ID NO: 5127 - protein, 47 aa, synthetic construct
KFKLWRKFYKLIRSKHHALLDRIKMKDLSMKNVGFIAARAEKLLKTA

SEQ ID NO: 5128 - protein, 28 aa, synthetic construct
RFKLLKKWFKRLQCVKTRLASAAVNKAK

SEQ ID NO: 5129 - protein, 62 aa, synthetic construct
KLRLYKKYIRKMQRKQYTRARAPKAKRLLSKSYVISPGRALALPQKDLYKLWLAKAESDLAC

SEQ ID NO: 5130 - protein, 52 aa, synthetic construct
RIKLMHRWFKKLKRKYCLVEKKLDYAAVARIACKLVRIAAADEKLLYIAATM

SEQ ID NO: 5131 - protein, 21 aa, synthetic construct
LLRIYNKIFKKLRCLKMHVLR

SEQ ID NO: 5132 - protein, 29 aa, synthetic construct
KFRMLCRWWKLLRPLITRRRLRVLAAMKA

SEQ ID NO: 5133 - protein, 49 aa, synthetic construct
FFKMFKRLLKRFKKLLRMLCLAKENAHGKGEYANPFKKAKHLLCCRNLY

SEQ ID NO: 5134 - protein, 70 aa, synthetic construct
MLKIYKRLLRLYTKKKHTATKLKRRANKQRAKTKMNEANNCAKREHARPANRLLVAITLKMAKNQFRKIK

SEQ ID NO: 5135 - protein, 50 aa, synthetic construct
RYRLITRLYKRYRPRGSFTLVHKKRKAPQRFAPFEAKKALSAHGKGARAL

SEQ ID NO: 5136 - protein, 30 aa, synthetic construct
RFKWLKRFYRKLRQQIKVLALIKPAKWAFW

SEQ ID NO: 5137 - protein, 26 aa, synthetic construct
RFRFLCRLIKLMRNLLYKPLLRPKNV

SEQ ID NO: 5138 - protein, 47 aa, synthetic construct
RFKYLRRLFRKLKKFIWKGDFLLTKWWAFLHAKVRAKPRHSREAAFY

SEQ ID NO: 5139 - protein, 82 aa, synthetic construct
LMRLIKKWYKYMRCLLLPKLLAYAKPLNAKMALTRMRKKRVRAMLDMHAVARMQLAWKDEALDALNLVYKRRGAVRLEEMFY

SEQ ID NO: 5140 - protein, 44 aa, synthetic construct
KWKWLRKLWKYFRKLNQLKLLWLANYARCPQKYRLKKMLKWNVL

SEQ ID NO: 5141 - protein, 55 aa, synthetic construct
LLKILTKMFKRLKKHKTNRALRLIKIMVKALNKAKLKAYPYLKLVRIKEIRHRHG

SEQ ID NO: 5142 - protein, 60 aa, synthetic construct
RFRMYKRILKLLRRPKFPLIIMCFWNRDWRPALNLAKCESERRRYIILAALKKLFKAAQK

SEQ ID NO: 5143 - protein, 29 aa, synthetic construct
RLKWLCKFYRLLPRARKLLRGWEYGTAHN

SEQ ID NO: 5144 - protein, 31 aa, synthetic construct
RLRWWCRLWRRMKKAAFAFKGQLKLSTELAN

SEQ ID NO: 5145 - protein, 38 aa, synthetic construct
RLRLFHRIYRKLKRGIQDAWRLRLQEMLALKKQKKLYL

SEQ ID NO: 5146 - protein, 27 aa, synthetic construct
KLKFLNRIWRMLCCLAAPLEVGKRYKK

SEQ ID NO: 5147 - protein, 23 aa, synthetic construct
KWKFIQRFFRRYTKAYDKLLLLL

SEQ ID NO: 5148 - protein, 24 aa, synthetic construct
YIKLMRKFMKLLKKIIALTRYAKY

SEQ ID NO: 5149 - protein, 24 aa, synthetic construct
KMRYFSKWLRWIKKSAALAYKPLK

SEQ ID NO: 5150 - protein, 39 aa, synthetic construct
KMRMFKKIFRFWTNLAACACRLAIARLCCLLEGELRKRL

SEQ ID NO: 5151 - protein, 44 aa, synthetic construct
RLRMLHRLWRKFRRTDRMWRRAYHKQRLDFDLLALQSAARKDIH

SEQ ID NO: 5152 - protein, 57 aa, synthetic construct
RFKFLKRMLKRFKKAACKHYPIKKLRTRNLPCPLMTHAGSRLLQLKRRLTAQRLQIH

SEQ ID NO: 5153 - protein, 22 aa, synthetic construct
KMRMLRRWIKLLNKAKVALFQG

SEQ ID NO: 5154 - protein, 25 aa, synthetic construct
WMKLFKKMLRLMTKIIQATTLRKKL

SEQ ID NO: 5155 - protein, 50 aa, synthetic construct
RLRWMRRYLKLIRSILRAAAARAYANAPWQLYRFLARLWWGHKNANRLRA

SEQ ID NO: 5156 - protein, 86 aa, synthetic construct
FMKFLRKWLKFMKRASQVHCLKKLLNARLTFMHKPRKRAVLRRSARPGCEKCAMRCTVKARRLDLFRLCQAHAARQICLKIQKKRL

SEQ ID NO: 5157 - protein, 24 aa, synthetic construct
LFKFMRRLLRRWPKLKRLPLEPDV

SEQ ID NO: 5158 - protein, 34 aa, synthetic construct
KLRILRKIMRKWHSLRATGQGTFAKALAPKLKDR

SEQ ID NO: 5159 - protein, 40 aa, synthetic construct
KWKLMKRMLRYLQNKLLALHFVHARPARHRHQGHKAYKAK

SEQ ID NO: 5160 - protein, 83 aa, synthetic construct
RFKLLSKLYRKYHHKKADHLALLFRKRGCAQLRYAKQRLRARKIKQIAYKAWALWAESGRRMQLKDLTLLFAMARGALWMRIR

SEQ ID NO: 5161 - protein, 48 aa, synthetic construct
WFRLLHRFYKKLKRAEKRDLYLLKKCLFKLKQAIRTKKNALCADKRCL

SEQ ID NO: 5162 - protein, 70 aa, synthetic construct
RLRLIRKFFRMFTRVPADHHSKANALQKRHLKAYYAALAIKLLKVHRKGKRWLAFDRVPNAKNLGWRLKL

SEQ ID NO: 5163 - protein, 79 aa, synthetic construct
RYRLLKRFWRKLRPIARHNDLHLATWLLLKKDRHAFIQYLLSKRMHRRKKLVISKRRINEKRLFASRSLLDDARWDASR

SEQ ID NO: 5164 - protein, 23 aa, synthetic construct
MFKIFRKWLRRLQRANLPLNLPR

SEQ ID NO: 5165 - protein, 39 aa, synthetic construct
FFKFFRRLMRRMRPFLLKCLVASTEAAAFERWLKRARYA

SEQ ID NO: 5166 - protein, 33 aa, synthetic construct
KMRIMRKIIKLFRRAKLCHHCKFKNAELALLNL

SEQ ID NO: 5167 - protein, 30 aa, synthetic construct
KLKIIHKMYKRIRPLPHKAYALLRRMRQML

SEQ ID NO: 5168 - protein, 65 aa, synthetic construct
RFRMWKKFLKKFNPMDAGLRCIALSLKFGSLKFVLKIKRLWSRKHARLDRRCKRKALAFAVRGLL

SEQ ID NO: 5169 - protein, 34 aa, synthetic construct
RFKLWKRIFRRIRKLASANTKKMALGCLLLTRTG

SEQ ID NO: 5170 - protein, 27 aa, synthetic construct
LLRFFRRFIKKIHRKPHQYKAALLLAR

SEQ ID NO: 5171 - protein, 20 aa, synthetic construct
KFKLLCKLWRLWSSKKKAWH

SEQ ID NO: 5172 - protein, 45 aa, synthetic construct
KYKYYPRLYKRLCRIKLRQLAAELLLLMLYGERKRSMLKTVMTDR

SEQ ID NO: 5173 - protein, 21 aa, synthetic construct
FYKYLRRLFRLIRRMKLALTR

SEQ ID NO: 5174 - protein, 58 aa, synthetic construct
KLRLFKKMIRKLHRKAVARFDKKCYRKAAKLPALLTGWAVHWMEKQRAKIRLPPCSCT

SEQ ID NO: 5175 - protein, 26 aa, synthetic construct
YFKLFRKLYKKMRRLAWGLKMREGLA

SEQ ID NO: 5176 - protein, 75 aa, synthetic construct
RFRLYRKLLKRFRRKFRYLWLTGGILEYKLILNARNLVKACKAYTPSKRRAADRLLAPQWLAIKMKARMILSSPI

SEQ ID NO: 5177 - protein, 33 aa, synthetic construct
KWKMLCRFLRFYTRAADDLLGRNQARARFAAGK

SEQ ID NO: 5178 - protein, 51 aa, synthetic construct
RFKFIKRIWRRWRSKKLGGALNKSTLNKRKMFALLLSRCKLCRAMVRHALV

SEQ ID NO: 5179 - protein, 37 aa, synthetic construct
KLRWWHKLLKKFRRDLSFWRPMLFLKTKSALEERFRL

SEQ ID NO: 5180 - protein, 30 aa, synthetic construct
KLRLWRKLLRLYKKMKRALKWMQLLHAKEG

SEQ ID NO: 5181 - protein, 25 aa, synthetic construct
RLKWFRRILRRIQCQAKTLATEKSL

SEQ ID NO: 5182 - protein, 25 aa, synthetic construct
RFKYFKRIFRLLQHYKNNAAKAKLL

SEQ ID NO: 5183 - protein, 47 aa, synthetic construct
LYRLIRKLLKRISKNVLQRVDVKAAKVRVNLAKMQALAFAGNPKENA

SEQ ID NO: 5184 - protein, 42 aa, synthetic construct
WIKIMPRLLRRLKRLDHMPLLLLCRHRKKASRRLLCKHKKYT

SEQ ID NO: 5185 - protein, 23 aa, synthetic construct
LLRIIRRYYKLFKKSLLLLKLAK

SEQ ID NO: 5186 - protein, 36 aa, synthetic construct
KIRMIKKFLRLWKQWCLKTLRALFLSTLAEARKLHD

SEQ ID NO: 5187 - protein, 81 aa, synthetic construct
KLKLFKRIWKLLKKATDMKFQRSNFFKRVADLRDLFALLYRAKAQICQARWWKKPRRASTCRSKTQNRKLLAAALEYNRWK

SEQ ID NO: 5188 - protein, 46 aa, synthetic construct
ILKWLCRFLKLFNQDLNVCGRARARLAFTRLLKLAKKRKQLDACRW

SEQ ID NO: 5189 - protein, 64 aa, synthetic construct
LYKLLPKLLRKWKKTDKIAKKQERAVRSAELKRNIWSLKALLAHWKFRHKLLGLFDFELHAEWS

SEQ ID NO: 5190 - protein, 70 aa, synthetic construct
FLKYITKFFRMLQNKRLRVLALDAMKAMPRKPKRSVLYRNAKKPNRDERLLADWLCRRLKINRALQKAPL

SEQ ID NO: 5191 - protein, 23 aa, synthetic construct
LYRIYHRYLKRFKHLAYRRTQAL

SEQ ID NO: 5192 - protein, 26 aa, synthetic construct
RLKFFNKWFKKYKRLYKNKALPLAAH

SEQ ID NO: 5193 - protein, 33 aa, synthetic construct
KIKMLSRWLKRLRKMAILRCKLARALLLHRNLR

SEQ ID NO: 5194 - protein, 40 aa, synthetic construct
LFKLFRKFIKKLRRRPSAILFKLDLGLAGLSAVKKVMDAS

SEQ ID NO: 5195 - protein, 100 aa, synthetic construct
LLKLFKKYWKWMKKKMPPACILGARDAILKHRLKKTRAKRASNKRHYLTQMKHKERKGARAKQFQCAAKCARAWWRDLVRLQNRRAKMPQHLCMGALKGK

SEQ ID NO: 5196 - protein, 25 aa, synthetic construct
RLRFYTRLLRRWKQLVLSAKRWMGM

SEQ ID NO: 5197 - protein, 54 aa, synthetic construct
KLRYIHKLFKLWRTRRAALAAAASAKMQAPGQLRVPIQTKQRATTMRLQDKARP

SEQ ID NO: 5198 - protein, 71 aa, synthetic construct
LFRFLTKMFKLIKRKRDIKNLYSALWMRALYLLIKDLFARNRLKLLQKGARANAEAPGMKPATQHAAKETA

SEQ ID NO: 5199 - protein, 78 aa, synthetic construct
YFKIFKKLWRKYRKHKHLILAGIVRLLQKMQLKGLCKFRAKLVNLLSPLCKYRRWRRAVACGLKMPDFAIPAALLYKA

SEQ ID NO: 5200 - protein, 28 aa, synthetic construct
RLKLYRKMFKLYRKEKKGRMALAPLHGA

SEQ ID NO: 5201 - protein, 81 aa, synthetic construct
RMRWLKKMIRFLHRQMKLAAPLLALYHSARNACDAFRHRNFLQGYQIKYFNKGKMLALIDRLRLAAAALRAAGAMKERKQA

SEQ ID NO: 5202 - protein, 49 aa, synthetic construct
KIRFYNRWLRWFRKAWIMAHTRLKLADSKWCWAAWCWKKDRRLRLFALK

SEQ ID NO: 5203 - protein, 29 aa, synthetic construct
RFKLFQKMMRILNKFLYRPAHLKRRLANQ

SEQ ID NO: 5204 - protein, 43 aa, synthetic construct
LYRMWSRIIKRLRKLMKAFCAAKRYSKTIQAARQDRRALYHKF

SEQ ID NO: 5205 - protein, 25 aa, synthetic construct
ILKLLRKLFRKLSCLLRDKKMCHAA

SEQ ID NO: 5206 - protein, 93 aa, synthetic construct
LLRLIKRLFKKFNRGAKKTLMYQRAHHRARSMLKVNAILQWRKRSNCDATKAAMEKFLNKLFLEKMVERLRKKRSRATVGRMLTLLYKKRKGH

SEQ ID NO: 5207 - protein, 38 aa, synthetic construct
KIKLLKKFLKFIHNAKLREKKRLQLAWDALFCLKEAVQ

SEQ ID NO: 5208 - protein, 63 aa, synthetic construct
FLKILKRMMRLLQPLKARRKHIERWKARKTCCLKLDAPYLACLLRWEPIYRRYIARAKRMPPN

SEQ ID NO: 5209 - protein, 28 aa, synthetic construct
LWRLYCRLIKKLRPRGQAKAFCRHLLAV

SEQ ID NO: 5210 - protein, 36 aa, synthetic construct
FLRLMPKFWRLIRNVLHAKLKSVMRKAKRPKKLALA

SEQ ID NO: 5211 - protein, 79 aa, synthetic construct
KLRFIKRWLRWIKRLLGKVRTLNGLANTARRRLKYFVRTRLKKRLENQLAGKAAPFDSLNSAAKDRATRWLNALVLLSW

SEQ ID NO: 5212 - protein, 42 aa, synthetic construct
RLKYLCRWWKKLRQAVRKAKLFKKNKTYPKLEHDQLAENLLA

SEQ ID NO: 5213 - protein, 55 aa, synthetic construct
KLKFYRRLLRKFQSRAVKKLGAIFIKIKGKKVRAPVKANYASLLAASQCGRMKAL

SEQ ID NO: 5214 - protein, 25 aa, synthetic construct
LLKWFCRFYRKLTPTITAALKMAKL

SEQ ID NO: 5215 - protein, 56 aa, synthetic construct
FLRFLKKLWKRFCKLAATKLMGSALHAKNLTLLKTSKFERPVYAADLLQAVSDHKK

SEQ ID NO: 5216 - protein, 43 aa, synthetic construct
KWRWFQRWLRKIRRDKKEGNRACRLAPKFLKAQALPHGLLAFF

SEQ ID NO: 5217 - protein, 43 aa, synthetic construct
FLKLWTRIWRIYKKFLKGKRQKEMRLLIAKMLAPLHRWLYLLA

SEQ ID NO: 5218 - protein, 49 aa, synthetic construct
RFKYLRRLFKKWHKRYKFYWLRHVKLYPLKRASAALDKLHLVQLAADQK

SEQ ID NO: 5219 - protein, 65 aa, synthetic construct
MIKFLHKLIKKLHKKRPAWQKKERLEKRCNLAAVKRLKAQWVLFKDLRPLERDLLTQRAGFKWAT

SEQ ID NO: 5220 - protein, 89 aa, synthetic construct
KFKWIPRIFKLFRHRKRQLSALFRKAALFKRLPPEMRRLLYMRRKLKHADSLAGAAKLDRRARPKCRFPLLSNLFADLACLKGRRALQQ

SEQ ID NO: 5221 - protein, 59 aa, synthetic construct
KLRLYRKFFKRYRNCRKDSRKKVWTVHLTARRAHAPPTRRVLENAAAYLRPPRLAADAV

SEQ ID NO: 5222 - protein, 20 aa, synthetic construct
FLKLLTRIWRKLTRRFQNEA

SEQ ID NO: 5223 - protein, 33 aa, synthetic construct
WMKFMRKLYRRYSRMRCKLLNLLFRNTRALKAA

SEQ ID NO: 5224 - protein, 64 aa, synthetic construct
IFKYLRRFIKRWRPLLIGWKVDRALALDEKMLGDGALLEILALEFKLKARKMAATRRKLKAVKW

SEQ ID NO: 5225 - protein, 20 aa, synthetic construct
KYRMMPKLIKKLQQKARCLA

SEQ ID NO: 5226 - protein, 28 aa, synthetic construct
LMRILKRWIRKLNKRKVDAALRKALLLR

SEQ ID NO: 5227 - protein, 67 aa, synthetic construct
RFRFLQKLLRRFRRTAAWEISLCDRLKAIHYWLANGKARRLAKCRCSIKIAEKAATFLFFCRNIRAR

SEQ ID NO: 5228 - protein, 67 aa, synthetic construct
RYKFWSKWYRKIRRLVKDVRAPHARLSVKPGWEAGALRLKLQAHLPLVRAAKRLHFAGVKAEKALAK

SEQ ID NO: 5229 - protein, 30 aa, synthetic construct
MMKFLKKLFRKLQKLTLNKLRNMWHRDKSL

SEQ ID NO: 5230 - protein, 27 aa, synthetic construct
KLRLYQRMFKFYKKCKQRLTLLAALGQ

SEQ ID NO: 5231 - protein, 45 aa, synthetic construct
KWRFFKKLFKYLRTKVAYLYMLRDAASPRTIAAKNHRAKDPLRRR

SEQ ID NO: 5232 - protein, 36 aa, synthetic construct
RMKLLKRFFRMIPTGYAMKTALQGRKARRRLCANPA

SEQ ID NO: 5233 - protein, 49 aa, synthetic construct
LIRFMKKWYRRLRKRAVKAAAESNRRLNRCKLINNEELAQAKKKPLAKA

SEQ ID NO: 5234 - protein, 44 aa, synthetic construct
KFRFLCRMLKWLRRRAANLRKHRSKLTLLRDEANLAYKKKKHQT

SEQ ID NO: 5235 - protein, 56 aa, synthetic construct
RLRMWKRLFRLLKKRKLALKPAKHMCLCGAKLLRLRHKDGLQYKKFKRTLCKFLSG

SEQ ID NO: 5236 - protein, 20 aa, synthetic construct
YLKYIHKLFRLFKQPLAANR

SEQ ID NO: 5237 - protein, 60 aa, synthetic construct
WWKLLKKMWKWMRRLERRCGAFICAAAFKRLWKDRAWLRVKTPFDLCAASCPKKKLCAIK

SEQ ID NO: 5238 - protein, 68 aa, synthetic construct
RFRLFRRFLRLMKKKTRLNKGANKPHKFLRGRICYDLRMNLATDRHENRAWLLWPMAKLQKAKNKKLP

SEQ ID NO: 5239 - protein, 30 aa, synthetic construct
KLRLFNRMMRRLRCLALKRLHRHWPFLKLK

SEQ ID NO: 5240 - protein, 28 aa, synthetic construct
WLKMLNRLLRLYKRYNGAVAALCKHRVI

SEQ ID NO: 5241 - protein, 30 aa, synthetic construct
MLKLLRKLFKLYRKADSKMMKKYAVMHALR

SEQ ID NO: 5242 - protein, 86 aa, synthetic construct
KIRWYRRMLRWIRTLRDTWKDERRFWRQRAKHRKRAFRAKPTWCAMPRWRANCRLASSKLLIPCHLNLSRAKLAALIILIMKLKLK

SEQ ID NO: 5243 - protein, 33 aa, synthetic construct
KLKYLRRFFKKFKRAKNAALRALGITLHKRILQ

SEQ ID NO: 5244 - protein, 32 aa, synthetic construct
LFRYLSKIFRKLTRAAKMAGLFFIRRHKRGFA

SEQ ID NO: 5245 - protein, 28 aa, synthetic construct
ILKLYKKFLKLLKCKSCHLLGILHRRRY

SEQ ID NO: 5246 - protein, 43 aa, synthetic construct
RLRLYKKLMRRLCRLQIFATAARRKLESRGNLYNANLSMGLET

SEQ ID NO: 5247 - protein, 34 aa, synthetic construct
RLKFYKKIYRKLRSQALLALNARRYIKPDCDEVK

SEQ ID NO: 5248 - protein, 52 aa, synthetic construct
KLRMLRRLLKMWKKKDLAHLSWQLLQMWAHAACKKEDKTYKGPKQWPHAKRL

SEQ ID NO: 5249 - protein, 60 aa, synthetic construct
FWRYFRKYFKKLKCQHRMRKLIPNTALAARRAKSLYKKEIEANAKSMLDGYKKAVKAALN

SEQ ID NO: 5250 - protein, 78 aa, synthetic construct
MLKMFTRLFRMLNRASRYRAKGSRLLMCAVRHSQRSYCALGIWTATLRRARLHIKHMARKTQALKILRWWWRKKAARA

SEQ ID NO: 5251 - protein, 31 aa, synthetic construct
RLKILKRMFRRLRTTAFKKYNKPAKSAALQS

SEQ ID NO: 5252 - protein, 64 aa, synthetic construct
MMRLWCKFLKKFPSCSADKHAARFHKKVQTRQLKVAAYLAWQRAKALTLKLDKDAARGRRGARG

SEQ ID NO: 5253 - protein, 40 aa, synthetic construct
FFKLFNRFMRKMCRLKTWAKLAALALRQALKPKKARDLLG

SEQ ID NO: 5254 - protein, 25 aa, synthetic construct
FLKLYRKLFKRLCRLKKKLDRLHLM

SEQ ID NO: 5255 - protein, 53 aa, synthetic construct
YLKIFQKMWKMIKSLKLNAKYLKNQLKNAKAMPRENRYGRLLERARQKLACKL

SEQ ID NO: 5256 - protein, 76 aa, synthetic construct
RFRYLNRWLKFMRKKLAPLLMQIKRVLAKKRLSRGHNRDARKAWGDDDAALRKAMRMAPHAALAMQAACAIRQVRF

SEQ ID NO: 5257 - protein, 51 aa, synthetic construct
KFRLWNKIFKFLRRGAMLFLAKFFRVLKLKLGSCKAASLCLMESALLKGHK

SEQ ID NO: 5258 - protein, 22 aa, synthetic construct
FFKMLRKMLKRLKCASKTAAMT

SEQ ID NO: 5259 - protein, 61 aa, synthetic construct
YIKLYPKFLRKFRSDLQCRLLKLIALDKFHKKWRLRWFKAKKARWKIRKYYFLRPLWAAMK

SEQ ID NO: 5260 - protein, 24 aa, synthetic construct
FWRLLPKLLRWLRSRRDRWHLAAG

SEQ ID NO: 5261 - protein, 47 aa, synthetic construct
WWRLFSKLLRKLHTKKMCSHNKCLCGWWAKRRAVPRQLALGARKNAR

SEQ ID NO: 5262 - protein, 35 aa, synthetic construct
FLRFFQKFLRILRKRKRKARAVENMVNFARALLGK

SEQ ID NO: 5263 - protein, 38 aa, synthetic construct
MFRFLRKLFKRLKQIRRKFWRDHLAAHLFIKLYNRQAL

SEQ ID NO: 5264 - protein, 29 aa, synthetic construct
RYRFLRRYLKKFRPQAHVIAAARLHRYAE

SEQ ID NO: 5265 - protein, 75 aa, synthetic construct
IFRFLKKLFKRIQRAGKHWHKSSRRKAPTKARDQKVLRLALPKAKKFRDDALVKMALKDNRTALRDEIAIYRPWA

SEQ ID NO: 5266 - protein, 66 aa, synthetic construct
RLKMMRKYLKRIKKARERCHRRICGWWRPHLAYIEAEANFKMDERRKKRCARMDMACPARALALAA

SEQ ID NO: 5267 - protein, 21 aa, synthetic construct
KFKLLTKFLKMYRRLVRVAFE

SEQ ID NO: 5268 - protein, 58 aa, synthetic construct
RIKLLKKLMRFMHSLKIAYLGRDVNKEFLIHAAKRAKMRSRKSAKMLQRKWRNAEFAT

SEQ ID NO: 5269 - protein, 38 aa, synthetic construct
RLRLWRRYLRRYSHKYAWLLVYALIKGKRWELELATIE

SEQ ID NO: 5270 - protein, 23 aa, synthetic construct
LLKLFKRFLRRFHKGGDLAYWKS

SEQ ID NO: 5271 - protein, 52 aa, synthetic construct
KFRYFRKFLRRLRTKAKSKRRLLRKHRRNRVVGYYWDWLKLAIDLDWGALLA

SEQ ID NO: 5272 - protein, 47 aa, synthetic construct
KLRLFKKLIRRFPPRVKRARAFLKVKRNTAYKFKRAFLLPADDLKAC

SEQ ID NO: 5273 - protein, 49 aa, synthetic construct
YLKLICRYIKILRRSKRNALKRRTMEAPKLMLLKPSRNGMCKRRAAHAD

SEQ ID NO: 5274 - protein, 56 aa, synthetic construct
RLRMLRKYFKKFKSLKLKRFGGKAKRAQKLADWADRRLYPVQAPTYLRVRWKILAG

SEQ ID NO: 5275 - protein, 33 aa, synthetic construct
LLKFINRFLRKLPKDRLPNAYIRCETKKLALLA

SEQ ID NO: 5276 - protein, 31 aa, synthetic construct
MLKFLRKMYRKMRNAASHCKRGAFRARHAPA

SEQ ID NO: 5277 - protein, 27 aa, synthetic construct
LYKLMTRLIRRFRKTGLKLDVRAAKTC

SEQ ID NO: 5278 - protein, 61 aa, synthetic construct
KLKMFRKFFKLFKRNLAGGRNADGESTNLRLLKSVMWWRRQKRTQLRRAIAKKKALHHFAA

SEQ ID NO: 5279 - protein, 67 aa, synthetic construct
RLKIWKKWLKLFKKVYSEPKMRDLWKAVADSDAEVRVKAMTRPFAGKFFAKLLARKRRLWLKAWRCL

SEQ ID NO: 5280 - protein, 74 aa, synthetic construct
FLRWLRRFYKWWCRRHLFLVKCAVLQRGVAAALARRFPMYLAVCKARRLKERLLRKHLAWIRALLEPHRRILPA

SEQ ID NO: 5281 - protein, 50 aa, synthetic construct
LWKLMHRLLRKFRRADAAMLGSRKKNTANKAALYRKKKQELKFGRKQKAL

SEQ ID NO: 5282 - protein, 60 aa, synthetic construct
RMKLLQRFFRYLTTTYKLAAAKHCLKFKKMMKWQRRTAKNKALCASRKDWRRSILTLACS

SEQ ID NO: 5283 - protein, 42 aa, synthetic construct
KFKLWKKMLKKWKNRRFCNAEAAAIKHCLLKEALKFRKCAWP

SEQ ID NO: 5284 - protein, 22 aa, synthetic construct
KMKYLRKWFRLLCRHGKAHLAQ

SEQ ID NO: 5285 - protein, 48 aa, synthetic construct
KLKYLRRYLKFFNKCALKRLLPAGSTQWPLRAKVDEKLAKWSKYYHLL

SEQ ID NO: 5286 - protein, 23 aa, synthetic construct
WFKFMKKIFRRLNKRALIALRAC

SEQ ID NO: 5287 - protein, 42 aa, synthetic construct
KLRIFKRILRFLNNFTQISRAKKVLLKPALVKDWKARKLREA

SEQ ID NO: 5288 - protein, 26 aa, synthetic construct
RLKYFPRLLRIYCKTHRRKLAWLPLW

SEQ ID NO: 5289 - protein, 41 aa, synthetic construct
IWKLLQRYLKKLKRRGLVLTMTRRDRALMRLKLLFWGLKKA

SEQ ID NO: 5290 - protein, 71 aa, synthetic construct
LLKLLKKWIKKLQNDEVLRMWMWLFPAAKHMNWNGASAARKASLVAFFGRKKRANACLKRRAQLKWRLVRA

SEQ ID NO: 5291 - protein, 29 aa, synthetic construct
RWRWLSRLWRRLRHNRRRLAAATKAMADR

SEQ ID NO: 5292 - protein, 50 aa, synthetic construct
LWKLLTRILKLFRKRKRRVLKINLLLKLLRKPGAQLWKHCQRLAPHESAI

SEQ ID NO: 5293 - protein, 34 aa, synthetic construct
RLKILPKFYRLYKKQLRGLSWRRATALSRAEWMK

SEQ ID NO: 5294 - protein, 56 aa, synthetic construct
RLRFFQRYMKRYKTWRMRRVLRHPQHFARAAAGKAEWAALNRMKLGRKHMLNLAAK

SEQ ID NO: 5295 - protein, 31 aa, synthetic construct
KIRLLRRLWKLLCTKCAAPLHALRYIIRGRC

SEQ ID NO: 5296 - protein, 30 aa, synthetic construct
KWKMLCKMLKRLSKLKKPACADKEVTDKLQ

SEQ ID NO: 5297 - protein, 38 aa, synthetic construct
RYRYLNRYLRFLKRTRVALNIFKATYAYTIKLRKRYML

SEQ ID NO: 5298 - protein, 43 aa, synthetic construct
RLRLWRKMWKLFKCARLLAMWRRKQLMEYKERNAPRWCARETW

SEQ ID NO: 5299 - protein, 51 aa, synthetic construct
LLKFLRRYFKKLQQIPKAIHRKGLPAVCDCLARADKEAPLRVKAVNKAAAG

SEQ ID NO: 5300 - protein, 65 aa, synthetic construct
KLRWLNRLMKLMKKKFLKARFKFIRPRHFHFRFKVIKYAGVKAFCRAALLLLAWDRTYLFSLTKQ

SEQ ID NO: 5301 - protein, 22 aa, synthetic construct
LLKILSRFIKKLRRAKLLRMDF

SEQ ID NO: 5302 - protein, 27 aa, synthetic construct
LWRLISKMLRKLRNVTRMARQLFAAAY

SEQ ID NO: 5303 - protein, 67 aa, synthetic construct
KFKWLRRLLKYLKPTARVYALPLALIKAHRLLALEANGCRMAKNNIILCRCMLMLWKRPPKDKRKDK

SEQ ID NO: 5304 - protein, 49 aa, synthetic construct
FWRLICKLMRKLRKWLYAPHKAATKGKLKLNRAAFWRKRCQLKHRLCSR

SEQ ID NO: 5305 - protein, 25 aa, synthetic construct
YLRFLQKWLKMLHRREYLRAKLLGK

SEQ ID NO: 5306 - protein, 97 aa, synthetic construct
KIRLLKKLWRLLRKWTTLVCAYQWLSVVLCLAKRFQYRYKAWLLFCDGANIRLKERKLNETKKHPWKKWLVLKRTKMWRMLHARAKQKDQAKLKASK

SEQ ID NO: 5307 - protein, 55 aa, synthetic construct
RLKYLCRWLKFWRKMSQLRNIVLKGLKLDSALMCRAALWSKRKACKTLLQLIGRA

SEQ ID NO: 5308 - protein, 25 aa, synthetic construct
KMKLMCKWFKKLNSKLLAQFNLRCK

SEQ ID NO: 5309 - protein, 39 aa, synthetic construct
KFRFLKRLWKRLKKLLQIRKYLEKMFFVATPAKQQLYTL

SEQ ID NO: 5310 - protein, 25 aa, synthetic construct
LFKWLSRFYKRLKRTSMLLLTNLWR

SEQ ID NO: 5311 - protein, 20 aa, synthetic construct
KLRIYKKLLKLYTTPHSAYA

SEQ ID NO: 5312 - protein, 58 aa, synthetic construct
RMRLYHKYLKRLKTRNIKLAQKHYVRWKACYLARNLMAMRANGAIRGQLRLKYSSATA

SEQ ID NO: 5313 - protein, 71 aa, synthetic construct
RLKLFRRIWKLFKRQMLTNQRKAAMLGIQTKARNDRAEAKPQANARRIAWPAIAQRAARFHARAKCKAWTC

SEQ ID NO: 5314 - protein, 32 aa, synthetic construct
LLKFYRRLLRRMKKSQMKLHGAREHKAHKLLA

SEQ ID NO: 5315 - protein, 23 aa, synthetic construct
FLKLMRKFLKLISRERQHASRML

SEQ ID NO: 5316 - protein, 45 aa, synthetic construct
LYKMLKRWLRRLRRARTKHANLDWFGPKSTARFVRKARQALDILT

SEQ ID NO: 5317 - protein, 37 aa, synthetic construct
KLKWLSRMIRKIRRNARGAAPSKKCLGMRIAAASLGR

SEQ ID NO: 5318 - protein, 41 aa, synthetic construct
RLKYFPKFFRYLPKRLKLAEAEKWLAHDLRNELHKQAKMLK

SEQ ID NO: 5319 - protein, 89 aa, synthetic construct
RLKLLKRIIRYFRKKWLKCLRKVCQQQFLALQKLSLKALTEFQIVQKLKAMKRAVVAEFIRRRARRVLLALRRYCASMDAPQQLEYRAD

SEQ ID NO: 5320 - protein, 20 aa, synthetic construct
RMKLIKKLLRMLSCHFPEAR

SEQ ID NO: 5321 - protein, 79 aa, synthetic construct
LFRMLKKMLRKLCQCHKYKTTTQLKAQRLAAKLVNGRRARKIKGKCILFRDTCSGAVVFTALLYRWLWKAVRKALRAAI

SEQ ID NO: 5322 - protein, 85 aa, synthetic construct
KYKFFRRLFKKIKKKKLEHEAEEWIAKISAAGFKALELARMKPRRALMRLWRRKLKAAHQWALFLRYWLTPRKGLALRYGQRKAF

SEQ ID NO: 5323 - protein, 45 aa, synthetic construct
WIKMLKKFLRKIKKLKLNCLLALNMARFMQKRRIRILSYPKDAWN

SEQ ID NO: 5324 - protein, 80 aa, synthetic construct
RFRFFRKWFKRLKKLQWLCNLRHPDQILWRLKFAMKRAHKRGVLKKKNFLAREPQAKTWMQHKYALNRQKLVAAASRRLA

SEQ ID NO: 5325 - protein, 33 aa, synthetic construct
FYRLITRLFKRLRRSKRLFRLARVRTLRAMEAD

SEQ ID NO: 5326 - protein, 29 aa, synthetic construct
LFKYMKRMLKKFPSERELAYARIILKQRL

SEQ ID NO: 5327 - protein, 30 aa, synthetic construct
KLKLFNRILRRLHRSRLRAFVRSLLLERPA

SEQ ID NO: 5328 - protein, 29 aa, synthetic construct
ILRLLNKIFRRYRNKLKDMMRKYEQSAAA

SEQ ID NO: 5329 - protein, 43 aa, synthetic construct
LLKWLNKFLKRLTRAGKAPERLDLTRANGKRRPPMGAQKRTVT

SEQ ID NO: 5330 - protein, 55 aa, synthetic construct
RYRIIKKIIKRWNRAARKLMYGFALHKEKLLMLAISAETALKHRELLEYRLGKIL

SEQ ID NO: 5331 - protein, 69 aa, synthetic construct
RIRLMQRMFRRLSCLVRLRRKNIKEQCRMLDRRAATRFLILRLQAGRSQDNNEAKRANNRELAKAACLA

SEQ ID NO: 5332 - protein, 32 aa, synthetic construct
IFKFLPRLLRKLRKLAARRVKLAMLKTKQTRC

SEQ ID NO: 5333 - protein, 63 aa, synthetic construct
RLRLYKKFYKLIKNRKSKRHACVDLELYRKKLAGNNERLRRYARLSGGAYGLLNGALQCLPAF

SEQ ID NO: 5334 - protein, 74 aa, synthetic construct
RLRWLHRLFKMIRKQLLYCACLATGFCNRRLYLKRTCKVQGRWAALEWLKRLFKFKLATAMSKEPLNSARLFLL

SEQ ID NO: 5335 - protein, 42 aa, synthetic construct
KWKLMTRWFRKWKRLHKRISAAKQHRLGFAALKRLKKTAFGL

SEQ ID NO: 5336 - protein, 87 aa, synthetic construct
RLRFFKRIFKMLRSRTDRMRRYTDWRRIALNAWRLKGTWRRKLSFALPREAESAARKASLLLLVLPHANFMLDFIAYKKKKKKFMAK

SEQ ID NO: 5337 - protein, 69 aa, synthetic construct
KLKFFPRMFRRYKRALSEPLTDRAGGEFAVRARKDLAAKKRDLCKKALYHQFRAATLRQLRDSAKQVFL

SEQ ID NO: 5338 - protein, 32 aa, synthetic construct
YWKYIRKLMKMFRKQTRELKALLMLRSLMYLL

SEQ ID NO: 5339 - protein, 34 aa, synthetic construct
RFRYLNRMWRKLRKMMKQAALCANTCLEVAPKAR

SEQ ID NO: 5340 - protein, 60 aa, synthetic construct
RLRIWSRMLRMMRKKYLAAMLRLGMYINHPLPAAKKRALELARALFTHQELMQYTRLRMA

SEQ ID NO: 5341 - protein, 31 aa, synthetic construct
KWRLLKRFWRMLHSKTKRWAKDMARKAMLWA

SEQ ID NO: 5342 - protein, 24 aa, synthetic construct
LLRFFKKWFKLLKKLARNEWLEHK

SEQ ID NO: 5343 - protein, 37 aa, synthetic construct
IFRLLKKYLKKFKKAAKTDAAACEHLNKVVKWRDQAG

SEQ ID NO: 5344 - protein, 21 aa, synthetic construct
KLKLIRKFLRLITRINRVIEA

SEQ ID NO: 5345 - protein, 51 aa, synthetic construct
RMRFMCRIFRLLRQARRAARKAMGLTRYRLARLADRYNILYIHKDEHKAKE

SEQ ID NO: 5346 - protein, 42 aa, synthetic construct
KFKLYRRLFRIYQNKLAARLAALQKKCINRCRVIAKGLGERM

SEQ ID NO: 5347 - protein, 46 aa, synthetic construct
KFRYLKRFWRLMRRLNHKRAGCEKDFAKRAACFARDKTLLLTLNKM

SEQ ID NO: 5348 - protein, 20 aa, synthetic construct
RLRLMTKYLKWFCRRWFALW

SEQ ID NO: 5349 - protein, 32 aa, synthetic construct
LMRWLHKLLKIFRRKEARGNKFIRSALELGAV

SEQ ID NO: 5350 - protein, 22 aa, synthetic construct
RLKWMKRLWRYLHKLRLARWFL

SEQ ID NO: 5351 - protein, 36 aa, synthetic construct
LFRLISKLLKRIKKKVFAPKEAVKKVPIHLLLKKLW

SEQ ID NO: 5352 - protein, 37 aa, synthetic construct
MFRLFRRMWKRLRRKDKQAKGEKLLEHQLRLLTFSLA

SEQ ID NO: 5353 - protein, 40 aa, synthetic construct
KYKFFKRILRRIHHLRKMAGCLLARSAAYKLAKHCRAARH

SEQ ID NO: 5354 - protein, 53 aa, synthetic construct
RLKYFKKYLRKIRCAELSAKLLAQFLKRHEAILFSYKRAAQMATLTIERPARL

SEQ ID NO: 5355 - protein, 96 aa, synthetic construct
KLKFLRKLFKYYHSAAVLAKKLLAEKTLTADAGGTRLTCRPRHSKWLLFTIPKKQFLSLKAKRPCAVNQALDKLLKPAPRLRPADHMRRFLSWKAR

SEQ ID NO: 5356 - protein, 41 aa, synthetic construct
RFKLIKRWMKKLRHLLMRSLCKAKGRLRALGAAELKKSKQD

SEQ ID NO: 5357 - protein, 40 aa, synthetic construct
FLKLLSRLYRRLSCRLRVHQIARLLKWHAAHKRNLAKDLG

SEQ ID NO: 5358 - protein, 38 aa, synthetic construct
YWKFYRKFLRKFRTLLIAFRQVAAVGDAALLAYQRRHL

SEQ ID NO: 5359 - protein, 35 aa, synthetic construct
LMKYLKRFLKKFKRLARRLYRMKAGAGHRAVDMHL

SEQ ID NO: 5360 - protein, 40 aa, synthetic construct
KYRFLHRLMKYLQKNRRFKLKTKHTMALAYCRAAGGPYAK

SEQ ID NO: 5361 - protein, 32 aa, synthetic construct
KLKLWKRILRMFKKADDLRTKQRTQPAAAETV

SEQ ID NO: 5362 - protein, 32 aa, synthetic construct
KLRWLHKWFKRLPKKFRCLDLLLFVGRYTLTR

SEQ ID NO: 5363 - protein, 38 aa, synthetic construct
IFKLFTRLLRRLCNKAYGLKPHRYTLPLRRCLRKGFYL

SEQ ID NO: 5364 - protein, 55 aa, synthetic construct
KLRMYRKLLKKYKRAARRLAHLYHQDKWFAEHRLTLILKKALWYVDQFKSPRANA

SEQ ID NO: 5365 - protein, 91 aa, synthetic construct
RYKLFNKFMRRWRQYLKIRVAAKNLRRRPKAKWLLTRFSFTVLANLALCHKTLPRRAVNKTKARKLHRRIRKLLRPPCRRLYHCVALNLII

SEQ ID NO: 5366 - protein, 51 aa, synthetic construct
FIRYFHRLLRRYSQLVARGATFAAARMETLKLVTPREKLALKLRFWKKKWL

SEQ ID NO: 5367 - protein, 22 aa, synthetic construct
RLKLLPRMLRKLPSDHHTRLLK

SEQ ID NO: 5368 - protein, 69 aa, synthetic construct
RIKLMSRFIRRLRQGLTKDALTRKFRAEFLHRLKARVAAALVKAALLLLLDALTKCKCQIVNVEKHILG

SEQ ID NO: 5369 - protein, 50 aa, synthetic construct
ILRMLQKLIKLYRRALILPSEAAFRRAHEASLFEHPANCKDKKLKIGAAR

SEQ ID NO: 5370 - protein, 29 aa, synthetic construct
KMRLWRKYIRMMCSLKKLEKAFLKLCLLN

SEQ ID NO: 5371 - protein, 60 aa, synthetic construct
YYKMYQRIFKRMHKLMLCKCLMQLLFEALPRKFKSRRKLWCLARRCKDSKADRKALTNLK

SEQ ID NO: 5372 - protein, 31 aa, synthetic construct
KFKYIRRLLKYLSKKRAIKAKWAKALDAIPQ

SEQ ID NO: 5373 - protein, 74 aa, synthetic construct
WWKIFKRLFKKFHREAARRLHRSLLLELMPQKLELTPQFPFARRRARGYMHARKLRWDASLDLLEPNRRAAKRT

SEQ ID NO: 5374 - protein, 31 aa, synthetic construct
KYRLFRRYFRFLSTRAAKKHKYADALMRAFM

SEQ ID NO: 5375 - protein, 29 aa, synthetic construct
IWKWMPRLLKLWKKARALRRKWQPAQTAA

SEQ ID NO: 5376 - protein, 45 aa, synthetic construct
KFKLWKKLWKLLKSGLCLYLRWAALKCMRRQLGSLAQCRDPFRCV

SEQ ID NO: 5377 - protein, 52 aa, synthetic construct
KLRLWRKMYKLLRCCKARPERRPSAQQCILAVELPLTKLASDAARRARMYLV

SEQ ID NO: 5378 - protein, 24 aa, synthetic construct
RFRLWNKWLRLLPRYKLQRDLLLK

SEQ ID NO: 5379 - protein, 22 aa, synthetic construct
LLKLMQKFWKKFRQALRKELLL

SEQ ID NO: 5380 - protein, 40 aa, synthetic construct
MLKLYKRLYRKIKNPNLALLLAGNRWARSLLYKQGDVATY

SEQ ID NO: 5381 - protein, 38 aa, synthetic construct
KYKFLRKLFKRFRRHIGLNLKLSWRNLFAARGQRFAQM

SEQ ID NO: 5382 - protein, 29 aa, synthetic construct
LFKFYKKLIRMLSNLRKNFLVAELYKEKK

SEQ ID NO: 5383 - protein, 22 aa, synthetic construct
KLKYLHRILKKLPNLRHTAGKV

SEQ ID NO: 5384 - protein, 29 aa, synthetic construct
KLRLYTKILKRLKKIKKKLKDLFLLMYLV

SEQ ID NO: 5385 - protein, 61 aa, synthetic construct
RFRLWRRFWRLFKRATIGKAAQHAAPNRSALKYEKRDYAKKPKAEAWLCKKLHKNFVAADH

SEQ ID NO: 5386 - protein, 20 aa, synthetic construct
RLKLFSKLYRRLQKAAADVR

SEQ ID NO: 5387 - protein, 80 aa, synthetic construct
LLKWFSRYFRRIKKVLKLTTWYRFKCDLRRPLRFLALRPRRNAVSARALFEAACRCYHLEAGARRKSNYFKLAFRASRYP

SEQ ID NO: 5388 - protein, 69 aa, synthetic construct
KWKMFCRLFRRLKRDKAKVSQGQLKKRHHALLCRFRLHMCIHFCRIEYARIRLLRRAARLWHDKAEAVK

SEQ ID NO: 5389 - protein, 21 aa, synthetic construct
YFRIFRRLLRIFHRAILAKRV

SEQ ID NO: 5390 - protein, 59 aa, synthetic construct
KIRFLNKFIKKWRREAYNRKRLARSYAQSWLSQGTIAAFLAANADLERRRPVRDRRKAL

SEQ ID NO: 5391 - protein, 79 aa, synthetic construct
KLRFMRKLIKLFKSKLKRKVSLSTVALLRCANLIRLHWRLARRRLMKSGIHLKCKMSKETPDLNRRMSWLARKLCLKHK

SEQ ID NO: 5392 - protein, 56 aa, synthetic construct
FIRLWPRLLKRFRKMRPRLTRWRIGNRRLHRKAFFLARLQAIKLFGGARVILLWKH

SEQ ID NO: 5393 - protein, 35 aa, synthetic construct
KMRLWKRLIKMFRPKRDLAVEARMAYAWKAPGKAR

SEQ ID NO: 5394 - protein, 21 aa, synthetic construct
KFRLMRKWLKWIKKLEPGAAS

SEQ ID NO: 5395 - protein, 92 aa, synthetic construct
RYKWFRKLYKKFRCLYKREATARAADSRLLAAFRREPQWDVIRRRNLDGLLTNAQGLKFKQGKRLLLGRQCRQRLDKDSLLEAAELAAVAQP

SEQ ID NO: 5396 - protein, 33 aa, synthetic construct
KWKMYRKWWKLLRKHAPRFRARAGFAALMAAGK

SEQ ID NO: 5397 - protein, 24 aa, synthetic construct
RLKLIQKLIKYMRKKAFELNDAQL

SEQ ID NO: 5398 - protein, 43 aa, synthetic construct
RIRMFTKLMKLLRHRAKKLRKLAKWLYKVQSNGALAYRTRSSF

SEQ ID NO: 5399 - protein, 21 aa, synthetic construct
YLKIFRKFLKRLRHMATLRDG

SEQ ID NO: 5400 - protein, 80 aa, synthetic construct
YLRLWKKMMRLIRPAMLRELARKMCKKEHLWHPAGAHGLINTKLEWHLLASSWKAAAGSAGWYKRAARLKAAKEEAAMKH

SEQ ID NO: 5401 - protein, 52 aa, synthetic construct
MLKMLRKMFKFFQRLARCGEAKHECFALEKKNNIRHRLKRNRARKNLFARLL

SEQ ID NO: 5402 - protein, 43 aa, synthetic construct
RLRFLPRLYRKFSPARLKVKLNTRKTACDRFNHKRDMLMAMLL

SEQ ID NO: 5403 - protein, 34 aa, synthetic construct
LMKLIHKLFRKLNPADKLTLGKMKRKNWRNLRAQ

SEQ ID NO: 5404 - protein, 27 aa, synthetic construct
KYRWLTRLYRRFKRASALHAPKLLQIN

SEQ ID NO: 5405 - protein, 33 aa, synthetic construct
LLRLYKKFMRLLKSRFLDNNIRWANDAAAMKKF

SEQ ID NO: 5406 - protein, 34 aa, synthetic construct
RLKLWRKFFKKLNHDLLRCHDTQMAFRYLSAKKK

SEQ ID NO: 5407 - protein, 80 aa, synthetic construct
KIRLFRKYMRRYKRDRAAIARGMDVEATLKKYAPSMLQALGLSILNFLCHARKEAEKYPLGTAARKAFNQAFANRLKAAK

SEQ ID NO: 5408 - protein, 57 aa, synthetic construct
RWKLLRRIYKRWKTPRELVHAWLLWARKRAYLMKKLEMLPNRRIADKCRCQLKLAMV

SEQ ID NO: 5409 - protein, 26 aa, synthetic construct
RLKLMTKFIKRFKQKALWLMLLKEEI

SEQ ID NO: 5410 - protein, 25 aa, synthetic construct
RIKFYRRLLRRMRNLWMAALRRENL

SEQ ID NO: 5411 - protein, 34 aa, synthetic construct
FMRLLHKYLRLLPKLAALQEFRKESKPKLKQPRY

SEQ ID NO: 5412 - protein, 23 aa, synthetic construct
KIRLWPKLMRKLKRHAAADSENK

SEQ ID NO: 5413 - protein, 42 aa, synthetic construct
RYKLFSKFLRRMRRMIIASEKIQRCANCKKWLLYKWLAAARK

SEQ ID NO: 5414 - protein, 78 aa, synthetic construct
RMKLLCRFLKLLRTDAKPAAEATTRKRLARNRWGALQRKWRNPIRYIGALQKLKILKKGVRAQGLARARMKKKLVWRV

SEQ ID NO: 5415 - protein, 54 aa, synthetic construct
YLKFFKKLIRKFTRPARLRHRLIRSSRAFRWALILLVLIFCGQCKALQAAAYRM

SEQ ID NO: 5416 - protein, 25 aa, synthetic construct
KFKLFCRFLRRLRPRAKGSMAQDQA

SEQ ID NO: 5417 - protein, 79 aa, synthetic construct
WWRILRRMWRKFRKYRGRNAARNPGRKGYKGMALLALARIPANHKVKQIARLEARWYAKAKPKIVFAKLALNDAALFRS

SEQ ID NO: 5418 - protein, 31 aa, synthetic construct
YMRLLKKLWRKYCRLARGDCWEAVKKLDTLK

SEQ ID NO: 5419 - protein, 29 aa, synthetic construct
KIKLINKLLKRFKTATPKLHAVPIAPRGL

SEQ ID NO: 5420 - protein, 42 aa, synthetic construct
LIRLFNRFWKRMKRRLKWTGLRPRAGDFRTRLLCLKTYANAK

SEQ ID NO: 5421 - protein, 95 aa, synthetic construct
KLKWLQKFLRRFRNLKRVMFKRPQADYDIKANITKAKIHAAAKRANCKKAARRFKTMYATARLKAWARLWKLARKMRFQDTLEKALAVTLQLQTQ

SEQ ID NO: 5422 - protein, 37 aa, synthetic construct
KLKMLSRFWKLLRRLLVITLLQNRKLDVAVQRRRNSG

SEQ ID NO: 5423 - protein, 31 aa, synthetic construct
RFKMFKKLMKKFTKCFLETKKPADALLWALR

SEQ ID NO: 5424 - protein, 37 aa, synthetic construct
RFKLWNKLLRKLRHLNLVMKTAAFLRVWCLYLVRTKT

SEQ ID NO: 5425 - protein, 58 aa, synthetic construct
RMKMLRRFLRKLRRKWREWLRLRRKVACGSDAKTAFDTIQRAWRGQLLVNAAFKARAS

SEQ ID NO: 5426 - protein, 39 aa, synthetic construct
LLRIMHRWYKILKKRARKDRNLFKKAEDTSATIAFALGR

SEQ ID NO: 5427 - protein, 26 aa, synthetic construct
MWRLLKKWLRKFRHKQQQLAPWLIKA

SEQ ID NO: 5428 - protein, 22 aa, synthetic construct
YLKFLNRFFKKMQRMLARLLLY

SEQ ID NO: 5429 - protein, 74 aa, synthetic construct
IYKLWSKLFKRMSCAVSQPCAERRFKKFNRAGTKLAYRLCLRHNYKARLDRALIWKARRLKNKRYARGAKKPIA

SEQ ID NO: 5430 - protein, 40 aa, synthetic construct
FLRYFRRLIKKLQCRCLYALKLLMRCAYADKHKQWSKRKY

SEQ ID NO: 5431 - protein, 77 aa, synthetic construct
RIRWMKRMLKYWPKAKLRLFALMAQMAKRLQAIDPLRGWATRARLKPTAGDCKRKFKAVCAAQLLQGAALRAVQDQN

SEQ ID NO: 5432 - protein, 22 aa, synthetic construct
MMKLLKRFWKLMKTNMLNAKKL

SEQ ID NO: 5433 - protein, 56 aa, synthetic construct
RMRLWRKFFKLLKKTTWHRIRNARAAYIRKAYMRTAAEMRLLTTLKKLARLLLTNH

SEQ ID NO: 5434 - protein, 61 aa, synthetic construct
RYRYLHKLIRYIQKRNLEKLHAKLLLVKFKQQAWDLNYRRHFDVVELRKRHCRLKLDRAAL

SEQ ID NO: 5435 - protein, 67 aa, synthetic construct
KMRILRKFFRRFTPTRKRATKWIIRRRLMPRSLAMVALATRKANATRIELPARYALEACDVAYLTAK

SEQ ID NO: 5436 - protein, 38 aa, synthetic construct
FWRFLRKYLRFYRQALAWRCAASRQWLLLMYLKQNRFA

SEQ ID NO: 5437 - protein, 30 aa, synthetic construct
LFKMIKKLFKYFNRRACHAKAMLRNLQGRA

SEQ ID NO: 5438 - protein, 28 aa, synthetic construct
KWKMLRKLLRMLHQWSRLRVRLDAGAKL

SEQ ID NO: 5439 - protein, 45 aa, synthetic construct
LIRFICRLIKLFRRARWLAKHKAEAKAGGKMIRARDRKLCVENSY

SEQ ID NO: 5440 - protein, 47 aa, synthetic construct
WLKFLKKMLRLFRRRTHATAKLFRKHAEQHCLLKFNKVIRWAHRVMK

SEQ ID NO: 5441 - protein, 51 aa, synthetic construct
WFKLLKKLMRKLNKLPTAPKTAAKMQLWLMNRKQQDGSFLLLIELRAELRA

SEQ ID NO: 5442 - protein, 50 aa, synthetic construct
FLRILRKIIRRFKRHLMVAPRAKAINYHLRAASVRCRGCMAIAMRASARK

SEQ ID NO: 5443 - protein, 54 aa, synthetic construct
FLRFYCKIIKKLTRMKAIIRAHRRALVRRAAAYRDLSRREILRLFKKARILRSA

SEQ ID NO: 5444 - protein, 35 aa, synthetic construct
RLKIYHKYMRMLPTRERLALRARFIGKHLKAAYLR

SEQ ID NO: 5445 - protein, 26 aa, synthetic construct
LIKFMTKIFKKLKKALPHKEDQRLLA

SEQ ID NO: 5446 - protein, 49 aa, synthetic construct
KYRMFRRYWRRLRNLARRARQRPWVANGCGCLRVHAAKKAHRAFSLLCR

SEQ ID NO: 5447 - protein, 31 aa, synthetic construct
RFRLLRKLLKLFRKKRRRAFICGLALPRSLS

SEQ ID NO: 5448 - protein, 37 aa, synthetic construct
KLKWLRRMFKMLHSLSQRTGLTKAKAFATTKVRRDAK

SEQ ID NO: 5449 - protein, 60 aa, synthetic construct
RYRLLSKIWRMLRRPMWRGDLFVKFNQRKLAKLAKRGQEAKHERKKKFYLPHAKLGCLLN

SEQ ID NO: 5450 - protein, 99 aa, synthetic construct
FLRYYKRFMRKMKKGLRNSNQAMKQLVHLAKAYACKRWLALYRRMTRCDKKKHVRRLKLFYVIKLKLLCLPRLLQARAMRLCPMKLAFKVKPAAPKRHR

SEQ ID NO: 5451 - protein, 55 aa, synthetic construct
MFRLLNKLIRRLQRRMATPIRGAVKKRMLLRCLIDLLRIAYRRAARLSDYNLKLA

SEQ ID NO: 5452 - protein, 36 aa, synthetic construct
KLKIIKKIYRRLNPEAVLECKKFRSAAAAPAVRKYA

SEQ ID NO: 5453 - protein, 38 aa, synthetic construct
MLRLLQRFIKRFSRAWRKRSESILTKLLYGREAKLMQR

SEQ ID NO: 5454 - protein, 26 aa, synthetic construct
RMKLMKRFFKRFKPMDARLDLAASKL

SEQ ID NO: 5455 - protein, 34 aa, synthetic construct
FFRIIRRYMRLFNTRKAYQAMRLWRLRLKRMPLL

SEQ ID NO: 5456 - protein, 22 aa, synthetic construct
LMKLFTKLLRFLTHAQKPRAHK

SEQ ID NO: 5457 - protein, 21 aa, synthetic construct
RIRLLRKWYKILQKLGSHLAI

SEQ ID NO: 5458 - protein, 36 aa, synthetic construct
ILKFFRKWIRRLRCEQALGDPKITLKLAANMRNRAR

SEQ ID NO: 5459 - protein, 80 aa, synthetic construct
LLKLMRRLFRRFRQAVVKRKDNNHCLAARAMLKRLRRMPSCVKPNWAQPLGRKMRKAFAKRLPNRLLPTKIKISLYLNLW

SEQ ID NO: 5460 - protein, 81 aa, synthetic construct
MLKLLKKFLRKFCTAHGFNKLLLALYKNKAVADALLIRIKRQKRCYRPACRAHFYVICKLAKEGCIEDAARAEDLRLLQKK

SEQ ID NO: 5461 - protein, 76 aa, synthetic construct
RLRYMKKLYRMFKKAEFADLALNRRYRKALHGILRENWLKILARLYLHAIRLARRNRTDLKKRCKAEHPLAGLPLT

SEQ ID NO: 5462 - protein, 29 aa, synthetic construct
LIRILRRLFRYLKKNLHVYKARDLVLGIG

SEQ ID NO: 5463 - protein, 77 aa, synthetic construct
ILKYFPRFFKKFKRKVRTAMMICARKAQPNFTDLLKRLKRAMRARKVTALREWRLEALLAHRNPFNALKRYHADAAC

SEQ ID NO: 5464 - protein, 28 aa, synthetic construct
KWKLLRRWFRKLPTEYKMLVMLRLAKSS

SEQ ID NO: 5465 - protein, 37 aa, synthetic construct
RLKWIKRMLRLFKRFDCARAISPKKLWIGRHLCRYLA

SEQ ID NO: 5466 - protein, 45 aa, synthetic construct
YLRLLQKWIRRLQKRASRADKARWLLRKLDNSMLGDALAAKYGYQ

SEQ ID NO: 5467 - protein, 48 aa, synthetic construct
RWKIINKIFKWFQKADYKAAKVLARARKLDACRVSAKWARARMLTKRP

SEQ ID NO: 5468 - protein, 62 aa, synthetic construct
RFKLFRKLLRYYKPAFPGLDAAYNFKKAQMAKEACRPQGLKVLFAAKRVWGDTAARKRLIAA

SEQ ID NO: 5469 - protein, 49 aa, synthetic construct
LIRFLPKWLRRFSPLRRFEANFKLAAWMKRKNCTLCKLLIKHAYLARKK

SEQ ID NO: 5470 - protein, 74 aa, synthetic construct
IYKYLPRLFRKIQPRDAMSQTYVKKRALASCLARLCFARLRLAGRTLALMMEKKLLLRLDKRRICQQNWQRKRL

SEQ ID NO: 5471 - protein, 21 aa, synthetic construct
KLRFIRRYYKWWRRIEALAAF

SEQ ID NO: 5472 - protein, 46 aa, synthetic construct
LLRLMSRFLRWYNKMRLAGRDMKPKARDHKARDRLMKCAELVRRVL

SEQ ID NO: 5473 - protein, 29 aa, synthetic construct
LLKLWNKLWKFLRHVRTCRELTACPKRER

SEQ ID NO: 5474 - protein, 28 aa, synthetic construct
RYRMMRKMLKILRRMNLKLANAARKLGQ

SEQ ID NO: 5475 - protein, 27 aa, synthetic construct
KMRFLHKMIKRFKQALLRQHNTAAGAR

SEQ ID NO: 5476 - protein, 36 aa, synthetic construct
MMKMLRRLFKRFKKARALTAVMRLRCSLAEYKHWRA

SEQ ID NO: 5477 - protein, 22 aa, synthetic construct
RLKFLSKLFKFWKNLLPALRDS

SEQ ID NO: 5478 - protein, 52 aa, synthetic construct
RLRMLKRLIRMLCCWGRKLHCWFQQAAYRLLFVTKKANLHKCRACSRAARLL

SEQ ID NO: 5479 - protein, 29 aa, synthetic construct
LLKFMQRLLRKLKRILALDGLNTRGVTKL

SEQ ID NO: 5480 - protein, 65 aa, synthetic construct
RLRLICRIMKWFKQIKSKRLALVRFWARNDLRLLMGLDPGMLKRKDVEKVRAVAALIVAKELKLD

SEQ ID NO: 5481 - protein, 38 aa, synthetic construct
RLKLLRRLYRLLRKKNQFDTRHAMDIRHFVGLVNAALL

SEQ ID NO: 5482 - protein, 24 aa, synthetic construct
RMKMLNKFLRKYQSARLGARSALK

SEQ ID NO: 5483 - protein, 60 aa, synthetic construct
KWRILSKMFKKLRRCAAMRGNLKVRRYFRALKKKQMHWASHALKAYQWPKAYKFRALAKA

SEQ ID NO: 5484 - protein, 22 aa, synthetic construct
KLKLFHKLLKKWKPLDHLFRKC

SEQ ID NO: 5485 - protein, 25 aa, synthetic construct
LWRLLQKIFKKITKRNAIRNDLLLK

SEQ ID NO: 5486 - protein, 42 aa, synthetic construct
KMRMLKRLLKRLRNARRLGKLKAEKLKRLCEVHETQPADHGW

SEQ ID NO: 5487 - protein, 21 aa, synthetic construct
MLRLLSRFLKKYRRELLAVQF

SEQ ID NO: 5488 - protein, 76 aa, synthetic construct
ILRLFRRFLKRLKKGKREALRNQKSMFCAFQEKTKTKRFKKLKLYAARICGKHNAILARSDARMIERILTLTAFKQ

SEQ ID NO: 5489 - protein, 39 aa, synthetic construct
FLKFMKKWLKKFRPKQLEDIKGADKLAFLAGRVYLVLAK

SEQ ID NO: 5490 - protein, 95 aa, synthetic construct
RFKLICKLMRYLSRIMPKLAAWLCWQLYARLQKRKACSRKLKQRNQKRHMCLLVERLQKFLPILGLARLAWKKLTAMWKRFLTTKGLAGQLELFA

SEQ ID NO: 5491 - protein, 45 aa, synthetic construct
LYKFMPRLYRMYQRLLAAQNQAKRTAQARAHLRKICKNAPNKDAR

SEQ ID NO: 5492 - protein, 80 aa, synthetic construct
LMKLLKKFYKRFRRDRFAQNRLKRMKAHLIFFLAAQANFKMADRKAAYMARADMRKTPIVAAHDLHRELKFALNKYKMTN

SEQ ID NO: 5493 - protein, 21 aa, synthetic construct
RLRLFHRLLRLIHKQLPAIKQ

SEQ ID NO: 5494 - protein, 91 aa, synthetic construct
KIKLLTRYFKKISHKKQVKCLPDFILAAYKLMADECRARPKRVRHKALGGKGIFAQKKRAIRHSARRAQKLWRAEAKAKQEAQLKPHLAAY

SEQ ID NO: 5495 - protein, 32 aa, synthetic construct
KWKLLQKWYRKFKRPLLAACLAAMAEIRVPSH

SEQ ID NO: 5496 - protein, 34 aa, synthetic construct
LWRMYKKLIKWWRNKQLLVLKNDADLRVRKALAL

SEQ ID NO: 5497 - protein, 51 aa, synthetic construct
FIRLLSKIFRLLKKRDRPKKHHLRFARKCACAYPRKRALGMLLRSRLCLTK

SEQ ID NO: 5498 - protein, 31 aa, synthetic construct
FLKLLRKFIRIWNRRMHFALARYLGGANALK

SEQ ID NO: 5499 - protein, 56 aa, synthetic construct
KLKLLSKLWKWLRRHYARHADKCAVFTCKYLYLQKANRWRLKLLDKRFGALKSAKW

SEQ ID NO: 5500 - protein, 40 aa, synthetic construct
WIKYLNKMLKRLHRQLLKDAGAAVQPKVRLKAAARAGKPL

SEQ ID NO: 5501 - protein, 20 aa, synthetic construct
YLKLFKRMLKKLRSAKADPY

SEQ ID NO: 5502 - protein, 51 aa, synthetic construct
RFKLLRKLYKRLTPSIDTKLYRKRIDKKKNALVLLQPAAPSHQWHRQKLAL

SEQ ID NO: 5503 - protein, 51 aa, synthetic construct
MIKLYRKFFKRLKKSLFLNAFRARRKSLLQALLYNKKYSRRHMAYTEACAL

SEQ ID NO: 5504 - protein, 53 aa, synthetic construct
IYKLLKRWLRLFKRFTLSALLLNAKRTALGAHLQLFKGNPRAHPHVREDQRAK

SEQ ID NO: 5505 - protein, 65 aa, synthetic construct
RFRFYCRWWRRFKKKQRPKKLWAAANVYYYGLLLFKLKRLRFHLALACGLTDSAEDQAKVLLKKH

SEQ ID NO: 5506 - protein, 20 aa, synthetic construct
WYRLLHKLFRLFRSRRLYLN

SEQ ID NO: 5507 - protein, 43 aa, synthetic construct
LLKLIHRILKFMPKEAKRMAKLLAFQMADARFAPMGNVDRRLL

SEQ ID NO: 5508 - protein, 64 aa, synthetic construct
FLKILKRLLKILCKLALMQSRHLHLDIWATRAQADWYRRLRKSPWRKLDARFKLARKHCNNPSA

SEQ ID NO: 5509 - protein, 69 aa, synthetic construct
LLRWMKRWFKWWNPAAARMFTLKLLDRWNAVAFYKAIKNAGCMLRKRRKTAQIFVGRKKVKFPKKRALA

SEQ ID NO: 5510 - protein, 20 aa, synthetic construct
KLRLICRYFRMIKKALVRAL

SEQ ID NO: 5511 - protein, 70 aa, synthetic construct
KFKLFKRFLRFLKRRKNASLCCDKVLAFRAAYPAAKQRGPGQERCWKGARKKHACAKWLATAWEAKQLGL

SEQ ID NO: 5512 - protein, 76 aa, synthetic construct
LIKFLKRYIRRFKQRARDGIARARNYQTVARLLLVCRAARKAILVRKLHRLECKAKLMSKELQLQKFLFNALSAYN

SEQ ID NO: 5513 - protein, 28 aa, synthetic construct
WLRILTRFFKKYKHLKADARLLWGRRHL

SEQ ID NO: 5514 - protein, 84 aa, synthetic construct
WFRLLTRFLRKWKQVKLLLSLPACPEVLALEACIYPKREKVMRAALRAALLVCAEAFARRARRWALPDRMRHDMRKQGKKCSLD

SEQ ID NO: 5515 - protein, 68 aa, synthetic construct
RLRYMRKILKRLRRLLQAKKACLGRRLRRCRLAATDEKNLKLFPLHSTKPMLPRLMKLKHKIHLNNAV

SEQ ID NO: 5516 - protein, 38 aa, synthetic construct
KLRLMKKIFKKLQKCCAVLLDSKHRRPHFAAMECVKAA

SEQ ID NO: 5517 - protein, 69 aa, synthetic construct
KLRFYSKYMKRLRPMRLENLKLDCILLALMWAISAQQKLEALLGSKYFQLLGRRFIRKNTLKKLRQLPL

SEQ ID NO: 5518 - protein, 49 aa, synthetic construct
KYRFFKRFLRLLSSLRILSTKWLFYPDKLLLIKFQARRTLLKMSRRVLV

SEQ ID NO: 5519 - protein, 40 aa, synthetic construct
RYRLLRKLLKKLKRILGALLRGAALQRRRHAEAACYDGRA

SEQ ID NO: 5520 - protein, 56 aa, synthetic construct
ILRLLRRWYKLYNTLMAALRHDPLYDAFAPRKAAKHRLCDVSQKRQLDHIAARRLK

SEQ ID NO: 5521 - protein, 27 aa, synthetic construct
KLKLYTRFMKKYKKHLAKRLLANALLT

SEQ ID NO: 5522 - protein, 62 aa, synthetic construct
KFRLICRMLKRLNRTRLLRETVCSARQAKKFWARAADNALERYGDRNLALAVRKIALLFCFK

SEQ ID NO: 5523 - protein, 23 aa, synthetic construct
KLRMWKRLMRWLQPTLLRAMIKS

SEQ ID NO: 5524 - protein, 41 aa, synthetic construct
MLKYLKKWFRRYHNFRFLHLHKLLRLPDLKKLEVGKRRRAN

SEQ ID NO: 5525 - protein, 33 aa, synthetic construct
RFKFLKRILRRLRHTFLVTLKAALVAMGRKRQF

SEQ ID NO: 5526 - protein, 29 aa, synthetic construct
FLRMFSKFLRWYNQPRRLFAARLLQERAR

SEQ ID NO: 5527 - protein, 58 aa, synthetic construct
KYKIYCRFMKKLRTLRCTLLELCFRLNRAMCIWLRKLLRKLKRNKLATAWKINKRTCN

SEQ ID NO: 5528 - protein, 65 aa, synthetic construct
ILKWMTKFLRFLRRRVPLRKQRLGLPRSMPRLARLLLILKIYTLWLMSRLLGGWRKRRWLKRPRR

SEQ ID NO: 5529 - protein, 37 aa, synthetic construct
RLRFLTRLYRWLTRVCLKKDLKAIKLGLTIAGKLCEN

SEQ ID NO: 5530 - protein, 28 aa, synthetic construct
FMRLLRKMIRKFPKAHRYACKVYANAAL

SEQ ID NO: 5531 - protein, 37 aa, synthetic construct
LFKFFKRLFKYLPCKFKEWMLKRAKILKRCNHVALLK

SEQ ID NO: 5532 - protein, 56 aa, synthetic construct
FIRYWRRLLRRYRKWKGSAQPRRIRKWLQDQLLAAPAELANKAMLFWNHLSLKATK

SEQ ID NO: 5533 - protein, 58 aa, synthetic construct
KLRFIKKIIRLFRRCMALKLARTRKCVAAKAKAHHMLKCARLWGHWIKNWDRYDRRLL

SEQ ID NO: 5534 - protein, 73 aa, synthetic construct
RFRMLKRFMRRLRKLARKLRHAVSHLNFEERCRRQECKAALPLEGNARGSKPLIRILAKSRMARKHLEAKAPC

SEQ ID NO: 5535 - protein, 29 aa, synthetic construct
RWRLFKKYLKLLRHRCAHCKWDLKPNAFM

SEQ ID NO: 5536 - protein, 21 aa, synthetic construct
KLKILTKMWKKLRTDLKMVAL

SEQ ID NO: 5537 - protein, 38 aa, synthetic construct
RLKMLKRLMKFYRSSHIWVRCRKAAAKRLLGLCQAVCK

SEQ ID NO: 5538 - protein, 45 aa, synthetic construct
RIRLLPKWWRLYRRSCLMKPARHALFKEILAHQGKGAKRAPRALV

SEQ ID NO: 5539 - protein, 20 aa, synthetic construct
WMKLIKKLLKFMQKREALYS

SEQ ID NO: 5540 - protein, 30 aa, synthetic construct
RFRLFKKYFKLIKKLRVRRQMYLRLALLIC

SEQ ID NO: 5541 - protein, 38 aa, synthetic construct
RLKLFKKMLKWYNRARCARILAWLWVLKNYIRAFNEIR

SEQ ID NO: 5542 - protein, 77 aa, synthetic construct
YFKFLRKIMRRFKHKLKQFKRLPRTKFNKKQYYDRLILLEFLLTFLKLAADAATALAPKLAGKDRKFAKQNHSYAKK

SEQ ID NO: 5543 - protein, 64 aa, synthetic construct
RWRLLRKLLRRLKKLTEMKACNAERLLGRRRPRKMMLRQKHKKALWNQLGAQSMLLLCETLAED

SEQ ID NO: 5544 - protein, 63 aa, synthetic construct
WWRILRKLLRRLRHLCRKAKLRQMPLKESADFRFCAWEGDHAQDAAVSKRKKQMKNRLKKMAG

SEQ ID NO: 5545 - protein, 60 aa, synthetic construct
RMKLLPRFFKKMCPRLYCKHAYFHNPLKKRAPLFRLQLIFLKGAESLKLRRRARMPRLWL

SEQ ID NO: 5546 - protein, 40 aa, synthetic construct
KMRWMKKFLKMLKRFLALRQKAGLEARLIVQIKGINRRIP

SEQ ID NO: 5547 - protein, 23 aa, synthetic construct
FLKLMTRYIRLFRNNRAYKIAAA

SEQ ID NO: 5548 - protein, 40 aa, synthetic construct
ILKMINKILKRISRLLAYDRHNMKKHALPLAKPAFLPMAR

SEQ ID NO: 5549 - protein, 80 aa, synthetic construct
LLKLLHKLWRYMNRLECDHARAGLAKKMFAKAAARLSLRHKSGMKADFARLYRLKKGDSKAKKHLKKCVGMTEVLRKDQL

SEQ ID NO: 5550 - protein, 29 aa, synthetic construct
FFKWLKRLYKFLSHNIRALCRLAELKKAK

SEQ ID NO: 5551 - protein, 81 aa, synthetic construct
FWRFIRRFYKKLRKDKHKRSALLSDNKMKLRANIAADRRIDSSRKARARDRPRGILPREPLALYAFKARSKLMDCAAYAIM

SEQ ID NO: 5552 - protein, 80 aa, synthetic construct
RFKYLRKFYKKLCKLFQTNLALPDMEVARQDKVHAPAKFAADLLWAKQLMAKKMWKRGLLGKKYMRALLDLKIAAEAGHA

SEQ ID NO: 5553 - protein, 50 aa, synthetic construct
RWKLYRRLFRILNQYIAHKLGKRLKRILQRLACVKSLYLAQRKLNMLTSW

SEQ ID NO: 5554 - protein, 83 aa, synthetic construct
KLRMLKKWIRFICRIDLKWAGTRRKQECAANRAWKPLKRNSWRAAFIGCHRRENKKAVMKWRRIYAKFSAALNLLLHFKALLR

SEQ ID NO: 5555 - protein, 60 aa, synthetic construct
RIKFLKKLFRMLRSAKSQQKKARMLRAPLLRLNVMSRRYDVRHANLARACFGFLADNGKD

SEQ ID NO: 5556 - protein, 65 aa, synthetic construct
LLKILRKLYRKFKKACYWWYAVTNNQCAQYSRALKRQKRHRCHLRLAAADNKLCAKALAAIDSLL

SEQ ID NO: 5557 - protein, 29 aa, synthetic construct
LWRLLNKILKLFSSIRKHLKLAKKYYSAL

SEQ ID NO: 5558 - protein, 100 aa, synthetic construct
RMRFFRRLYRRLKSHRVLMLTLTMRNHLLCSKLSQRKYLRKNLLKIAAVMWLRARWRPLRKAVDLNLHLRHGLQLLAWFRLSPAKALAAHNKAEPPAWEV

SEQ ID NO: 5559 - protein, 70 aa, synthetic construct
MMRLFRRLFKKLRKLGDTADAKKNKKYHSSWRALMKEHRVTKKETAAKARLMNRLLSLNGLAQLNVAPKF

SEQ ID NO: 5560 - protein, 49 aa, synthetic construct
FLRIMKKLLKKMHRRWLSLALRMGPMHMKARKLYRALAFKACRSQHPLA

SEQ ID NO: 5561 - protein, 67 aa, synthetic construct
MFKLFKKWWKMFKSKENKQRILALKNLSRLPFHIRKARQATQQSKEHLKKKKLAKLMLYQLFAQRKA

SEQ ID NO: 5562 - protein, 23 aa, synthetic construct
RMKMLPKLFRKLNRAGRGGQSAL

SEQ ID NO: 5563 - protein, 61 aa, synthetic construct
RWRIFPKILRYLRTMHALGAKFQKRAQTKKQLALKARRFKATKKRKAALAKFRMNTKQCAR

SEQ ID NO: 5564 - protein, 61 aa, synthetic construct
RYRWFRRYLKKFRKYATLNAMKCQRELLLWQIKKLGLTRARKAMASAPRHLKLWLLDIKVD

SEQ ID NO: 5565 - protein, 64 aa, synthetic construct
RFKLLKKLLRFYKKEPRYMLRGREYRPSAHTCATRALKCWGATLRCTNRRAQARARFQGKRAAP

SEQ ID NO: 5566 - protein, 25 aa, synthetic construct
RLRFLRKFWRLWTRAMGLRRDASLQ

SEQ ID NO: 5567 - protein, 25 aa, synthetic construct
LFRYFKRLLKRIKNTAFKLLLAARL

SEQ ID NO: 5568 - protein, 30 aa, synthetic construct
KLRLFRKLLRKYPPAKYAIMIRCITGQLKR

SEQ ID NO: 5569 - protein, 48 aa, synthetic construct
RWRIYKKLLKKLHPKKAATPNAPRLLRKPRSMVRNAAGRLSTARRKLT

SEQ ID NO: 5570 - protein, 29 aa, synthetic construct
LFKLIRKFFRLIRCLALKNDNLLYKLKLK

SEQ ID NO: 5571 - protein, 60 aa, synthetic construct
RMRWLKRFMKWFQSNRKLCHLKKAHVIGFIKALAMRAALWKYDLMDAKLQRNRVLATALL

SEQ ID NO: 5572 - protein, 58 aa, synthetic construct
IFRLWRRYLRRLPKLILNIAWDAPLGNRLRRPMAYALLDRFRVFKARPRAPLGPRQRM

SEQ ID NO: 5573 - protein, 58 aa, synthetic construct
RLKFLNRMIKKYKKAMKPIVHALACRRPILKIHFKLGRMARKRLWKAELSWEMKCLLK

SEQ ID NO: 5574 - protein, 46 aa, synthetic construct
LLKIYCKFLRRLSHRNCRKAGQIAANAAARACCCRVKHRKRRQKIN

SEQ ID NO: 5575 - protein, 63 aa, synthetic construct
FYKWIKRYYKKMKKKCMEADKCALALMKLVAANLKAHSKRPCLALKARKKAKVERQPTKDWLA

SEQ ID NO: 5576 - protein, 34 aa, synthetic construct
FYRWLRKILKRIRKQATSAKLARTKLKHPYDYAA

SEQ ID NO: 5577 - protein, 24 aa, synthetic construct
ILRMLQRLFKKWRKSWQAARKGAS

SEQ ID NO: 5578 - protein, 64 aa, synthetic construct
RLKIIPKFLRFFTHLCAPRKRVYRKLKIWKWLWAAASCDIAALKRALRKKRALLTHAQLIKAKR

SEQ ID NO: 5579 - protein, 73 aa, synthetic construct
YWRYFRRYIKKWQKSLNVAALKSLLRKVKLAAHWLKGWCLLLRLEEPRMLRRRLKAPKLSICQLSVAAAALKK

SEQ ID NO: 5580 - protein, 72 aa, synthetic construct
FLKFLSRWIKRLKKLCLPALRQAKRKARPLLKLMRGCGWQMICSKYRPCLAHKKFRPASKPARLKLTWDTNK

SEQ ID NO: 5581 - protein, 52 aa, synthetic construct
LIRFFTRLLRLYRKLSKQAPDLRYKIKQPAQERLRKDKLRKYSDHVLRKADM

SEQ ID NO: 5582 - protein, 80 aa, synthetic construct
WLKFLRRILKRFKTLFNNEDLLRARWPGEKSCCFLRKDQRQGARIQLRKRLWSIRHAAKAIGRRAAMAAIYIRADKMRAA

SEQ ID NO: 5583 - protein, 41 aa, synthetic construct
RYRLLRKLLKLLPKTYKELALLLPQARGLKKKLMCKLAPDI

SEQ ID NO: 5584 - protein, 32 aa, synthetic construct
RLRLFQRWMRKLKCDFYAKLWAYPYLKADADK

SEQ ID NO: 5585 - protein, 50 aa, synthetic construct
IFRYLRRMFRFLKRSKQAMRWLAGDLCLFMKACDYLLRLMDKKMLAAKAR

SEQ ID NO: 5586 - protein, 31 aa, synthetic construct
RFKYWKKLFKLLTRMIGKLLELRLNPQAKLK

SEQ ID NO: 5587 - protein, 40 aa, synthetic construct
KMKYFKKLWRIYKNDRLETLAKRCALEDQRCRLRRAHAFA

SEQ ID NO: 5588 - protein, 49 aa, synthetic construct
KLKLMKRLFKKLHHLLKAKLCRPRMESKRFIPAKAKSACLNQKELIKMW

SEQ ID NO: 5589 - protein, 32 aa, synthetic construct
KLRLWRRIFKKLRKLDCSCEGAFLKLQIVAFL

SEQ ID NO: 5590 - protein, 51 aa, synthetic construct
RYRMLRKFFRLYRKRLAQGARIMLVNLYEKRLLSNGYQDILKPARAARTLA

SEQ ID NO: 5591 - protein, 25 aa, synthetic construct
FLRLMRRFYRLLTPLYLTSHVLRKA

SEQ ID NO: 5592 - protein, 52 aa, synthetic construct
MMRFLCRMFKLLKKALRDLHTPLRYKMPARLCHKHLKRKKGAKHHTARMRKA

SEQ ID NO: 5593 - protein, 30 aa, synthetic construct
LFKFFRRFLRRFHQRNLYKLKLALHFDLAM

SEQ ID NO: 5594 - protein, 63 aa, synthetic construct
RWKLLKKMFRRLRSREKAWTKAVSLRKLDAAKRAKKKTITCKCLVGCFSKNLRWAAAVLIKSH

SEQ ID NO: 5595 - protein, 56 aa, synthetic construct
FIKWFRKFYRRLKRIRAILAQAHSAMLVALRALACVKKCKRCYAQVSRLKVLGAVL

SEQ ID NO: 5596 - protein, 70 aa, synthetic construct
KFRMFRKYLKWFKRPCWELDLLPKLRRIKSDCYKRKKKFLATVAQKKEADFLRMRMRDLRAALVAREGAL

SEQ ID NO: 5597 - protein, 33 aa, synthetic construct
RIRLLRKLLRLFKREAYIKWELLHCGLRCVAGT

SEQ ID NO: 5598 - protein, 37 aa, synthetic construct
RLRLLQKIIKFLRKWFKIRISRLTLMWPATRVLFRAA

SEQ ID NO: 5599 - protein, 53 aa, synthetic construct
RWKLLKKLLKKLKKECKACLPLQMVKRSCAILALICRACKLDFCLSNLKWRTY

SEQ ID NO: 5600 - protein, 21 aa, synthetic construct
RIKYFRKYLRFLRKAGNSALH

SEQ ID NO: 5601 - protein, 20 aa, synthetic construct
LFKWYSRFMKLLRRLRPLIK

SEQ ID NO: 5602 - protein, 65 aa, synthetic construct
KMRLLRKLWRYFSSLRRKRRMVFAKKYNRDAQVAHMDLLLRLAKYDLYKIGDGLRCARRLNLKKR

SEQ ID NO: 5603 - protein, 20 aa, synthetic construct
WLRFLSRMLKKLKPACRWPR

SEQ ID NO: 5604 - protein, 40 aa, synthetic construct
YIKLYTRLLKRYKRLRNARPLRTELETVRALWLHLAYLKR

SEQ ID NO: 5605 - protein, 35 aa, synthetic construct
KYKLFRRLLKRLRHSKAYISPAITKKLSQLWAMRK

SEQ ID NO: 5606 - protein, 27 aa, synthetic construct
RIKILKRLLRRIKTQVAQAYAKLKMCL

SEQ ID NO: 5607 - protein, 40 aa, synthetic construct
KLKMMKRFFRLFSSACKKGILALPKAWSALLFKDKRRTKE

SEQ ID NO: 5608 - protein, 89 aa, synthetic construct
KFKLFKRLLRKYPKLAAHKARRAELPKRELKKEARADREVLLSPLWRRFAFGKQAALGMKYKKRNKFKLRLGPQLCRFTRLMVTTPSYD

SEQ ID NO: 5609 - protein, 54 aa, synthetic construct
RWRFIRRILKRLHHPAALMTAAKLATSVPEKAKLGRKLTYLMHTAKKLLCEKQI

SEQ ID NO: 5610 - protein, 46 aa, synthetic construct
KLRMWKKFIKRFKRHAVKAALRGGRLTLAHSDKNLFRPAKMAKYLA

SEQ ID NO: 5611 - protein, 56 aa, synthetic construct
LLRLLRKIFKYLKSFRKLAKAEKIQLRLRCAKLSLRASIMTSYALKDAQWLLCRRR

SEQ ID NO: 5612 - protein, 38 aa, synthetic construct
RFKWLKKFFKLLKCREEALMELNATAHLKKRQVGRHFK

SEQ ID NO: 5613 - protein, 70 aa, synthetic construct
LIRWWHKFIKKFNKPITVGRWAAGVNAKLKKQANRAAAASPKWPHKRRLRLRACRVARLRVREKAEGRVK

SEQ ID NO: 5614 - protein, 29 aa, synthetic construct
YLRYINRLLRRLKRAKLYDIADQRKLSAR

SEQ ID NO: 5615 - protein, 34 aa, synthetic construct
LFKFLTRLWRKFQSLTQAFWVRGKLRRARRLWRL

SEQ ID NO: 5616 - protein, 27 aa, synthetic construct
KLRWLRRWLRKIRTRQAKIAFLSFLLQ

SEQ ID NO: 5617 - protein, 28 aa, synthetic construct
RLRYYPKYLRKLKHLKMATKMGVLEASR

SEQ ID NO: 5618 - protein, 52 aa, synthetic construct
RWKLIKRMLKILPTLHAKPSAARRALLGMLKITLRKFKRKLRPRLGARIRLL

SEQ ID NO: 5619 - protein, 92 aa, synthetic construct
IFKLFKKLMKMLKRNVLALILRRYGCLGRAKKKKLRLWNGTYWDRRGARGSHICKIMHAKLKGCLRERHMKKGALTKVLLLKKAVWALYKSC

SEQ ID NO: 5620 - protein, 38 aa, synthetic construct
RIRFYRKFLKRWKPSFHRLANAQAKTQKHGELAKTLAL

SEQ ID NO: 5621 - protein, 28 aa, synthetic construct
LLRILKRLIRRMNKLFGPLDKEGAQALM

SEQ ID NO: 5622 - protein, 49 aa, synthetic construct
LFKLIRKFLRKFTRELGLKPAKLKHRRAALYCGHYLAPHRKNKWGVWWL

SEQ ID NO: 5623 - protein, 75 aa, synthetic construct
FIKWWRRLWKLMRRNKNHREWAEPAARNAALVKRRIKKVAGMLLLKFKHVLRSACCFDLREAAKSNRKVQARLWL

SEQ ID NO: 5624 - protein, 90 aa, synthetic construct
KLKLLKRLYRKWPRLRRYKPKRFMMKMALDWFVNHLLSFVKARMFAFRLKNRPARRHLNEPYRSKAVGRMKCWWAKPCLLAKLWHLWALR

SEQ ID NO: 5625 - protein, 81 aa, synthetic construct
KWKWYRKFLKKFKSIRELRKLKRLRGCQRARHLPPHCAKQQKEKALLSLHKSVRRLYLYAWIARCAKCRKLSWRIMDLAAR

SEQ ID NO: 5626 - protein, 74 aa, synthetic construct
RYRWLRRFLKLLRRRSQACVTRLLYKKRHQLLARTHLVDKLSTYKPDKKKLRAASINVFQAALNIKDWCLTRER

SEQ ID NO: 5627 - protein, 72 aa, synthetic construct
WIKMLRKLIKRLQCYAAHLLLRRRRASLLKARAAKKRRVEIRWRRHYLLLWNDTCLWAMVRRCKNYHWKGRD

SEQ ID NO: 5628 - protein, 46 aa, synthetic construct
KLRILCRLYRRWRHKKEQKMLLKKDFMAFMIALLQKAAPVYFLVRR

SEQ ID NO: 5629 - protein, 20 aa, synthetic construct
FLRMLTKLFRKMRRLFQTKA

SEQ ID NO: 5630 - protein, 79 aa, synthetic construct
KWKIWQRIFRMINCPCLRRKLKGPALGARKLEKRMTKTAKKIELNARRRIAQRERFLAAKFAARTALFKKHKNQATATV

SEQ ID NO: 5631 - protein, 82 aa, synthetic construct
FFKFWHKMYRMFRQAEKPAGNHHEARATCRIKNNKEKLLKKKYKQRWAKDLQYALSKLRKEAAAAAILASKRGARRKRCKFK

SEQ ID NO: 5632 - protein, 26 aa, synthetic construct
LLRLLRKFFRKFRHERNMCIYLLRAA

SEQ ID NO: 5633 - protein, 84 aa, synthetic construct
RMKIWTKFIRLFRKRNKHGLAKRQIVLKRKRIKAQVAALQVDLLDPNLAWAKSYKRDKELCDAHLTKANHRLASQKLRKACLAQ

SEQ ID NO: 5634 - protein, 49 aa, synthetic construct
WMKFWKRYFKRLTRQFLRGQWMKKQAKALLLQVARLSNTKPSFLARLKL

SEQ ID NO: 5635 - protein, 32 aa, synthetic construct
RWKWWHKLFRRFRRMALKYAREQANLRSWLKA

SEQ ID NO: 5636 - protein, 28 aa, synthetic construct
RIKLWHRLWRLWPRAQANAARCPLKRDL

SEQ ID NO: 5637 - protein, 58 aa, synthetic construct
RWRYFKRFLKKFRKTRENQLRHCYCAAAAFLARAKWAALADIRLAQKLRYRYNYDAYN

SEQ ID NO: 5638 - protein, 36 aa, synthetic construct
YFKLFRRFLRLMKKLNERKLPRFALVLRWKDLLLYA

SEQ ID NO: 5639 - protein, 21 aa, synthetic construct
LLRIYSKFWKKWQKLNKAKLS

SEQ ID NO: 5640 - protein, 47 aa, synthetic construct
LLRLYKKLWRKIKKNRKKQCCETWLIDRAMVGARLPYLARLNACKLG

SEQ ID NO: 5641 - protein, 55 aa, synthetic construct
FLKIIKRFLRLLRKATKRPSSYSAKRWKEDLFKLDIHRKKLLPICSAETKAADAA

SEQ ID NO: 5642 - protein, 32 aa, synthetic construct
FFKILQRMYRKFHKKELAKAARRPLRWFLVAC

SEQ ID NO: 5643 - protein, 91 aa, synthetic construct
LMRFYHRLFRKIRTIKKRMKRHYSAANRIRDIKTWVNRAIRARAELLVRERLLRAYLKLRLFDETRCLFQKLNHFMEALFRLAAAAKSRSK

SEQ ID NO: 5644 - protein, 30 aa, synthetic construct
LLRLFRKLLKILHKPKTARKAASKGKTIRL

SEQ ID NO: 5645 - protein, 88 aa, synthetic construct
WIRIYKRMFRKFRCAAILRNFYLKLRDQFIFKKIKLGRTDARTAAKLQAARYRRLKAPAANAKAKMKRVTYVATWIYLEKLAAKYNKW

SEQ ID NO: 5646 - protein, 63 aa, synthetic construct
RWKLFCKYLRKFKRLLYRAAAYELLVQRSADYASRMRCLILWATKRFVYRPIHKARDARKGLR

SEQ ID NO: 5647 - protein, 54 aa, synthetic construct
KLKWYPKLLRIWRRAPALGTTRALDMKTLEIRASKYLREAGARTWKALQLQASL

SEQ ID NO: 5648 - protein, 21 aa, synthetic construct
KLRLYKKLLRLFRRQAKLPRA

SEQ ID NO: 5649 - protein, 37 aa, synthetic construct
KIRLFKKFLKKLKRGNLIKKRSLFWDYHAADLWAQLI

SEQ ID NO: 5650 - protein, 71 aa, synthetic construct
LLRLMNKFFRRLRKNLYWGNNKKNAKRARRALVLKKAVDVDEARLMACVLRRLPIIDLRLNRGIHEAYRFR

SEQ ID NO: 5651 - protein, 85 aa, synthetic construct
KYKLYSKFLRRLQSLKLDPEIKLKMQNDYGKARLSWCPKLLKAVTQLLRKKLFWKLPRQKQRAMRGLKKQKLGMRQANRKRLALH

SEQ ID NO: 5652 - protein, 34 aa, synthetic construct
KLRIWRRMWRMLKSEKLAAAYWCCLLLQKLWATH

SEQ ID NO: 5653 - protein, 26 aa, synthetic construct
LIRIFTKLLRLIRRNKGLRLVMLSAR

SEQ ID NO: 5654 - protein, 40 aa, synthetic construct
RIRYLRKLYRRLQKAAFKDWRSLCAYDARMYRRKHETLAL

SEQ ID NO: 5655 - protein, 48 aa, synthetic construct
FYRWLCRLLKKIKSYLRMAPQKKTSNRELMLYTLRAGWHRRQALRRAL

SEQ ID NO: 5656 - protein, 41 aa, synthetic construct
LFRLLRKFYKILKKQLALHRSTKDQYLDKRQARLKKYAASH

SEQ ID NO: 5657 - protein, 49 aa, synthetic construct
KLKFIRKYLKRFTRRLAAKLSHADLCLDAVCQLRHTEAVDRQLKIACNA

SEQ ID NO: 5658 - protein, 50 aa, synthetic construct
LIKLLKRLYKKWKKTLKRQLLKAPMCARVKIRDIQERCYDAMRHASAKAA

SEQ ID NO: 5659 - protein, 39 aa, synthetic construct
RIKFMKKLLRKFPRHKLLLYKCSARTAAVVAAMKPQGKC

SEQ ID NO: 5660 - protein, 47 aa, synthetic construct
LIKMYQKYLRKIRRRAKAECDPRIYADLELRAAAMLCMRKLAPPNAK

SEQ ID NO: 5661 - protein, 48 aa, synthetic construct
WLRIFSRLFRKLKCLKAWILMSLQRRPKALKKCWLGRAGGRYNLKKCE

SEQ ID NO: 5662 - protein, 22 aa, synthetic construct
LIKILRKLFRIIKKREAYWYLA

SEQ ID NO: 5663 - protein, 82 aa, synthetic construct
RLRFLKKFIKKFKKDRAQGKLKKFLLFPYAQWAKAKHKIAHLNLTAAAAPYVKAFFKPARCLLAKRWKYMRAGGVILFFLLQ

SEQ ID NO: 5664 - protein, 51 aa, synthetic construct
RLKLYKKLFKMFQRLILNALRKYYCAAHWALAVLRKSERCCRAHMAATACK

SEQ ID NO: 5665 - protein, 51 aa, synthetic construct
LLRLWNRLMKLLRHMRRDRRLRDWLTKPFWKIRERTLWRVVALRRLWKAAW

SEQ ID NO: 5666 - protein, 33 aa, synthetic construct
KLKLFKKMLKKISRIRRLKQMRVRDLAANACLA

SEQ ID NO: 5667 - protein, 65 aa, synthetic construct
LLKLFTKFIRLLPNLRRLAVPSKPDLLALPKKARWAVDSDNKKQTMRLKMTKRKIKDHGAAAVRN

SEQ ID NO: 5668 - protein, 49 aa, synthetic construct
KYKFLNRFYRLFKKETRCPWLALNLLVLRIDLRTKRRANKDAGAALKKR

SEQ ID NO: 5669 - protein, 52 aa, synthetic construct
KWKLWRKLLKLIRCAYLLFKLSHNVQLTKARLDMQIANKTSLFVKRLPLRRW

SEQ ID NO: 5670 - protein, 56 aa, synthetic construct
KWRIFTRYMRKLNHAQMNLTLKKARKQIAAAMASAERLAYALYSVKKLKRLLRAAR

SEQ ID NO: 5671 - protein, 45 aa, synthetic construct
IFKFLCKWMKKLNRKKTDKAVLNHKKLRALARRQAVSLFRNKSYA

SEQ ID NO: 5672 - protein, 25 aa, synthetic construct
LLRWLRRLLRLYRKLTQKAEADPRG

SEQ ID NO: 5673 - protein, 78 aa, synthetic construct
RYKWWKRLFRRYSCKKRAVARLTAAQLAMRILWQFRLIFYFKRKKCWKANVHVCHRLQKIRKRAVYAALLRLLHNRKP

SEQ ID NO: 5674 - protein, 32 aa, synthetic construct
ILKFLTKLIRKFKKAQYRLFAHCSAAMLAKRL

SEQ ID NO: 5675 - protein, 50 aa, synthetic construct
RLRLFTRMFKWFKRRRAKRKQLSWYRLQWTIRLLCALKRKHDLLKLLTQR

SEQ ID NO: 5676 - protein, 36 aa, synthetic construct
FLRLWQRWLRRIKHPAALELLRKLKRLIKIMKEAYD

SEQ ID NO: 5677 - protein, 21 aa, synthetic construct
KLKFFRKLMRYLSQAHAKHAR

SEQ ID NO: 5678 - protein, 37 aa, synthetic construct
RFRLIRRMYRYLTTKQLLKRKLPHRFWDWLSAALARL

SEQ ID NO: 5679 - protein, 39 aa, synthetic construct
RMKWLSRLMRKLKKYGRGAACYAFLAGDKLKAHTLNFKY

SEQ ID NO: 5680 - protein, 56 aa, synthetic construct
LFRYFCKLFKKFRTYRPQWLLRRSLVRANMRRKRRTNLAARRLLDCLHPYLDRKWE

SEQ ID NO: 5681 - protein, 31 aa, synthetic construct
MWRLYHRLIKLWKRAAVTKLKKLHGICHLLK

SEQ ID NO: 5682 - protein, 50 aa, synthetic construct
FLRYLKRFLRLFKKLEHRPLKLNVNLPAKRHNKDTIKARDAFKRVNCLRD

SEQ ID NO: 5683 - protein, 76 aa, synthetic construct
RLKFFTRFLKKWKCKDLHYLHALKAVAPRRKIRNVSEKLKAWVQNACLLRSLLRNHRRKKAFPDDKAKKAADQQQL

SEQ ID NO: 5684 - protein, 50 aa, synthetic construct
FLKWLKRMLRRFHCAFSLLKMPVTEAARLRIRKIWARHRFYAMALKRKMK

SEQ ID NO: 5685 - protein, 20 aa, synthetic construct
LMRIYKRYLKYLNRHLKLWA

SEQ ID NO: 5686 - protein, 94 aa, synthetic construct
LFRFWKKFWKRLRKRAYLKCAYKRRWARVMYLKLVFMNKRLALALLQKHYLRFERLLIRTLLHRDDQSNEVQLKLRDHLRRKWLAPVSKAPALT

SEQ ID NO: 5687 - protein, 25 aa, synthetic construct
RYRLWRKFWKKLKQILNKKLPAHAL

SEQ ID NO: 5688 - protein, 63 aa, synthetic construct
KFRIMKKLLKFLSQFLKAKQPKIRKAKTWTLKVALHFKKYLRLKRAPLFSQKKRLKLDLSAKL

SEQ ID NO: 5689 - protein, 58 aa, synthetic construct
LLKLWKKLLRILKKCTRDRLLAPSLQAANCHHYLKKKLRCTENSKQAKRFLEFEWPLL

SEQ ID NO: 5690 - protein, 22 aa, synthetic construct
LFRLWRRLLRWFKSALDIADAK

SEQ ID NO: 5691 - protein, 72 aa, synthetic construct
RFRYIKKLYKKLKCAKLHPKWYKLLRPENFSASPDLAWEVLPKADYSMLKLRRALRAGWYRYRLNLPKKRAL

SEQ ID NO: 5692 - protein, 36 aa, synthetic construct
RMKLFQKILKYLRTFARQKAKLSAKMWHTPLLAKIK

SEQ ID NO: 5693 - protein, 46 aa, synthetic construct
KYRFLRKFLRFLKKKAALAAQLVLAARAPVRSWWMVKTALTKKARA

SEQ ID NO: 5694 - protein, 41 aa, synthetic construct
KLRLIRRILRKLPSRVRLWLQVPMDAEQRKLRLAVKQGKSY

SEQ ID NO: 5695 - protein, 65 aa, synthetic construct
KMKLWTKIYRKLKREPASALIMFDLLRCRDAAVYRCALTKACVKLRLNQEAATLLKKLCVVTPLR

SEQ ID NO: 5696 - protein, 60 aa, synthetic construct
KLKYWRKYMKKFRHKAKLARLCPQALAKKRAQDFLKQRKNYVMAARVDRVYLRTAKGMAL

SEQ ID NO: 5697 - protein, 32 aa, synthetic construct
LIRIFRRLFRRYTKLNMANLTKLKKLSLIADA

SEQ ID NO: 5698 - protein, 66 aa, synthetic construct
YYKIIPRIIRRLSRARLKLPNMAKRLFRHLHKKCYLALRLANLDRKAYNRKLVMFAAIEMLVAAVR

SEQ ID NO: 5699 - protein, 36 aa, synthetic construct
RFKFLHKIYKFFKKARKALGATLAKEPLGRACDIAH

SEQ ID NO: 5700 - protein, 88 aa, synthetic construct
KFRFIPRFYRLMQRYGMKAKCANLDAARKARKWRKAHIRQKLEATTLRAAHKSLPQALRALKSKIQRLKQRHLYKRTNKKFAHAKKQA

SEQ ID NO: 5701 - protein, 21 aa, synthetic construct
LLKMLTRWLRRYRKPYNCSAR

SEQ ID NO: 5702 - protein, 67 aa, synthetic construct
LYRILKRIYKWYQRKFALKAKKALREAANSREKRFLNAMDKEAHRQAILALPCAKLKVLRGAREWRL

SEQ ID NO: 5703 - protein, 29 aa, synthetic construct
KWRFYKRWLKKWKNKACAKLFLLDALLAA

SEQ ID NO: 5704 - protein, 33 aa, synthetic construct
LLRLFNRFLKLFSKWFANKLKCGPKNRKLPAAK

SEQ ID NO: 5705 - protein, 43 aa, synthetic construct
KIRIFKKLLKKMKNLLRQIKCLGLSAKVARLRCYNCKRQCAQE

SEQ ID NO: 5706 - protein, 30 aa, synthetic construct
RFKFLKRWFKKFKPLALAMSNNQRGDLARA

SEQ ID NO: 5707 - protein, 24 aa, synthetic construct
RLRLIKRFLRRFTPLSYSAFRHKA

SEQ ID NO: 5708 - protein, 23 aa, synthetic construct
KLRLLTKWFKKLNKLLKQYNTFR

SEQ ID NO: 5709 - protein, 52 aa, synthetic construct
KMRLYTKFWKLIKQCATPTMAAVARAAQAIRHNAYKKAYRIELLLKQKAKAM

SEQ ID NO: 5710 - protein, 52 aa, synthetic construct
FFKMIKRLLRRLKKMYLLGAAEKSKLNPIRLANWFAHKGVLRQAHLKNAHCR

SEQ ID NO: 5711 - protein, 90 aa, synthetic construct
RIKLYQRFIRKLSSMETLAWAYYAHSTKAAKTYMWNRLATRRAIVSKAKEKRHKLWRICRARLKNIPSLLKVKCYACLLRKLLPAARRAK

SEQ ID NO: 5712 - protein, 31 aa, synthetic construct
RLRLFKKILKKLSCLKVLRARLGIAFFRSEA

SEQ ID NO: 5713 - protein, 99 aa, synthetic construct
RFRMYPKFLRLWNKICYAALRRREYEAKLRRNRRLCAIKRLMRNGRPVHALEWSQNALRAMRRARAQKRVLAVAKGHLAKIEALHVRAEAQRKADKASS

SEQ ID NO: 5714 - protein, 30 aa, synthetic construct
LLKFWTKLFKRMRRSDQLGILRRAASDSRA

SEQ ID NO: 5715 - protein, 84 aa, synthetic construct
KIKMMRRMYRRFSTRALRLKSLLKVKIEADPARKEMEAKLKAPRPKKGKLKTQAKVLNLCELLRNVSKQLVSPRLARNWALLLL

SEQ ID NO: 5716 - protein, 42 aa, synthetic construct
MLRYYNKLLKLMKTKDLQLRKAICQYMAWAKWVALREWLLAK

SEQ ID NO: 5717 - protein, 32 aa, synthetic construct
LIKLLHKIFKRWSCLDKAQLLDGRRVGAAYAR

SEQ ID NO: 5718 - protein, 45 aa, synthetic construct
RWKFITKLLKRLRRLPTLRVKIMEFKASITKCLQSSWKKKALAAS

SEQ ID NO: 5719 - protein, 27 aa, synthetic construct
LFKIWKKMLRRIRRAEGAWNANRDNAA

SEQ ID NO: 5720 - protein, 96 aa, synthetic construct
LLKWYRKFWRKMQNKREHLLHGKLKWAWALLKVHMHVARPKNLSDAIKQNSALVIKLLQLKVFWRALRLAMHFARCAAAHLRLYKFKTQRLAKTKA

SEQ ID NO: 5721 - protein, 98 aa, synthetic construct
KIRFLQKFIRKFPRHLLKLRLIQKLYGKSLACLKRLKIKAARICYASLRLLKDLKRRLQQACLQCLMSYLCRHAAKQALDKKKNVCVAWSGLRIAHRN

SEQ ID NO: 5722 - protein, 21 aa, synthetic construct
RMKMMTRMWRFFKKLAAALKS

SEQ ID NO: 5723 - protein, 38 aa, synthetic construct
KIRLINKIYRMITRPAAMLQFSAAIHKRALLKKMLKLT

SEQ ID NO: 5724 - protein, 40 aa, synthetic construct
KLKLLRKILRLLPKCANAIMRILLYRRRNTECRKEAKDRR

SEQ ID NO: 5725 - protein, 29 aa, synthetic construct
ILKYWKRLFRLLRHRAKTELRGTLHRSCF

SEQ ID NO: 5726 - protein, 40 aa, synthetic construct
FWKLYQKLWKKLRRNEAHYRKMYAAKELLEHRRQGEHLRL

SEQ ID NO: 5727 - protein, 20 aa, synthetic construct
LYKIWTKWFRMLKKFLAKAS

SEQ ID NO: 5728 - protein, 97 aa, synthetic construct
KIKFLKKYMRFLNKLKAHQKAKAKVRGHRWKGKLRKDCKANRMRELYKRLQACKTHLKRAKQLQAVHAELRAKILRYMRRIENLAAAENRYQLPYDK

SEQ ID NO: 5729 - protein, 36 aa, synthetic construct
KYKYFKKYLKRFKHCYACEAKLLNLAKCTWPLKKAN

SEQ ID NO: 5730 - protein, 57 aa, synthetic construct
KFRFFKRFLKWMRCHALRYCTLRHARRERAFLGGNTMRAQLKGVLFDKLKNARRALL

SEQ ID NO: 5731 - protein, 32 aa, synthetic construct
FFRFIRRFLRLLTKPMRAMWCAARKSLLLKRL

SEQ ID NO: 5732 - protein, 38 aa, synthetic construct
LFRLLKRLFRLFRKLAHASKTMMLAAIETRTEDYGLRR

SEQ ID NO: 5733 - protein, 39 aa, synthetic construct
ILKLFKKFLKKLCRALYRKFEAAKANLSAQAAVRTMSDN

SEQ ID NO: 5734 - protein, 63 aa, synthetic construct
KLKLLSKFLRKYQHLSLAHIARAIKTMLISRLGFGDSNHPARKRSWLKAKRRCRKLLNPAGHK

SEQ ID NO: 5735 - protein, 73 aa, synthetic construct
KIRLLHKYLKKFRRLRRRFKTLNRFYRYKWCAIKAQKLALKLQKLKKIILACSHGWRDRCPDRAFVFARALAM

SEQ ID NO: 5736 - protein, 43 aa, synthetic construct
KFRLFKKFLKRLSRAFLAPQKYRLKPVIDKALRKHLGNQRATN

SEQ ID NO: 5737 - protein, 38 aa, synthetic construct
RIKYLTKLFKFLHQKKHLKQHAALPLHLYKKAPDLPAK

SEQ ID NO: 5738 - protein, 47 aa, synthetic construct
KIKLYHRFLKRLHHRAKRRARLLEYHLARHFASFWKRHWQAAPRNNY

SEQ ID NO: 5739 - protein, 55 aa, synthetic construct
RLKLYRRWYRWLSKIHAAKNRYLRHLAQLRKDDLFLRFARVCQEHLLKKALCGLI

SEQ ID NO: 5740 - protein, 69 aa, synthetic construct
KLRLLSRLWRRLKSDPYKNNKWRLKQYLIRLDKQALRLDLRSFAERNIMFWLGRLALKMQWMLDHFALA

SEQ ID NO: 5741 - protein, 67 aa, synthetic construct
LLKWFSRFWKYLKKLAAKNELCKIVRAARKLWRLFRMAKMAAKDLYVMWNDKKVDWRINLEAQALKT

SEQ ID NO: 5742 - protein, 54 aa, synthetic construct
YFKIFSRLYRRLRCVLLLTLKKFKLKALIKFLITGRGPRPVAAFAPRLAKKKKN

SEQ ID NO: 5743 - protein, 53 aa, synthetic construct
FLRWMQRLWKIIQTRRPRNRHLLHRAAGIKPGLLRTQLQKELAKNRKRAKKPL

SEQ ID NO: 5744 - protein, 25 aa, synthetic construct
KMRLYRRLLRFYQRRLAHLCAIELS

SEQ ID NO: 5745 - protein, 45 aa, synthetic construct
FFRFMTKLFRKIRNAPAAKNNMSLLKRRYKLREEIGLYKRAALRF

SEQ ID NO: 5746 - protein, 49 aa, synthetic construct
ILKLLKKWMRKIKQWHYLRCCANLVAKLPCRKAAARYRKLSKASEHFLC

SEQ ID NO: 5747 - protein, 86 aa, synthetic construct
KLRFLKRMLKKLKKREIAARAARHTLLELHKKAKPSIRLTLHVVMGGLPRRFEWAYKPAYKCRWLRGLKSRACVRNKLGTKWNCTL

SEQ ID NO: 5748 - protein, 20 aa, synthetic construct
FLRWFNRFIKKLQTAKPLAR

SEQ ID NO: 5749 - protein, 21 aa, synthetic construct
KLKFLCRFFKKFRPKLLKALL

SEQ ID NO: 5750 - protein, 62 aa, synthetic construct
RMRFFRKIMKKYNKKCKLFKNLAKKKAAANAAFLVLRAGSELLCNACLSYRNLKKPETAKWF

SEQ ID NO: 5751 - protein, 32 aa, synthetic construct
LLKFWHRMFRMLRRLCMGALKPGQARRHRALF

SEQ ID NO: 5752 - protein, 45 aa, synthetic construct
KFRMYSKMWKILKHNNAIRLLKLRASWRMKKHYRWYLAAKGAVRL

SEQ ID NO: 5753 - protein, 54 aa, synthetic construct
RLKMLRKLYKLYTHAHGDPHWRPAFRELKRLYNLLSMYLALDRKTKRRARVYKK

SEQ ID NO: 5754 - protein, 92 aa, synthetic construct
FLKLYKKILRKFRRAWLAGRSARACANLGRMAKLKTRTIKRIYLKANKACRTWLKCYKLLRHEERHECRRYRKSLPAPKRGGCAPKMVLKCR

SEQ ID NO: 5755 - protein, 43 aa, synthetic construct
FLKIFCRWIRKIPRAFLHRLLLKHEKIRMGKLGRFLSKKAIKA

SEQ ID NO: 5756 - protein, 78 aa, synthetic construct
YLKWLQKFLKRFRTQRTILAEFNWAAACKKIAASWLLAHLILDAKSAATNKRFPAKALNYKKKAAKVKKFVKLPQLAK

SEQ ID NO: 5757 - protein, 32 aa, synthetic construct
IYRLMRKWLKFLRSKRAKYALKLRAGIKTMIS

SEQ ID NO: 5758 - protein, 85 aa, synthetic construct
RIRILQRLIRFLRKGRRNIDAGATYRKMIGLAIAAAMARRHRTPAKRLAVRQAFLLLRKHLRLMKIDAFRPNAANLRLDGEAEPA

SEQ ID NO: 5759 - protein, 38 aa, synthetic construct
FFKLLRRWWKLFKQTKDATLSKDALHQDKKNRAILRSA

SEQ ID NO: 5760 - protein, 40 aa, synthetic construct
RIRLWCKLLRLMNRQEKHHAAFKLRKRRLVRAALPIRLKR

SEQ ID NO: 5761 - protein, 69 aa, synthetic construct
FFRFIKRMLRLLKKEKIKARLAAIIKACLVKWLAFKKSNEKCLSRMGKARKAILDKRWYQIRALRVNMM

SEQ ID NO: 5762 - protein, 21 aa, synthetic construct
RYRLLSKWLKLFKKRTSAYRL

SEQ ID NO: 5763 - protein, 28 aa, synthetic construct
LMRFYKKIYRLLHKRRLIARLRATTAKL

SEQ ID NO: 5764 - protein, 31 aa, synthetic construct
RWRLFRKILRFLRSCTKAQKKERVHLTADAA

SEQ ID NO: 5765 - protein, 25 aa, synthetic construct
YWRLLRKMLRLFRNLPATLGRRCAV

SEQ ID NO: 5766 - protein, 60 aa, synthetic construct
LMRWLKRLWRRYRRNKMLAHNCRRRAKAASWAARVLKKKANWVAWHGHLRRRPAAEHLIM

SEQ ID NO: 5767 - protein, 50 aa, synthetic construct
LMKLLKKYYKRLQRRTGGPDLCRRKVYLDSTKKCAAQAKWDAAIALARLK

SEQ ID NO: 5768 - protein, 36 aa, synthetic construct
LIKFFNRFYKRWRKRLEALEAGAILKTRALSAHVAG

SEQ ID NO: 5769 - protein, 44 aa, synthetic construct
RFKFYRRLIKWMSKRSAWLPARLKRNTWLHHLQARLKKARKLPY

SEQ ID NO: 5770 - protein, 71 aa, synthetic construct
FYKWLTKFFKYMRRKLRQRLSLHDREKAKKPKGLKAHRHRREHALLFKAAALYPSALDLYPVIALCVAKKL

SEQ ID NO: 5771 - protein, 36 aa, synthetic construct
MWRIFRKLLRRMKKLCKLFWHDRRIWLQRAAAQNLG

SEQ ID NO: 5772 - protein, 40 aa, synthetic construct
KMRLYNRILKRLKNRRLLADCARNAGKEDRNRMCRLLAPL

SEQ ID NO: 5773 - protein, 25 aa, synthetic construct
KLRWYKKLYKRLRKTAIAEAHWKAP

SEQ ID NO: 5774 - protein, 49 aa, synthetic construct
KLKLWKKLIKLFSRMLARKLDRQLATKMRMRAAGLNPACSIDRKRPDRQ

SEQ ID NO: 5775 - protein, 35 aa, synthetic construct
RYKWFRKMLKLIRRGMKYTMPKKLELARAALCRTA

SEQ ID NO: 5776 - protein, 44 aa, synthetic construct
ILRFLRKFLKKFNRKRLAILMAMTAWQALRRAARWKWQLYAQTW

SEQ ID NO: 5777 - protein, 45 aa, synthetic construct
LYRFLRRLLKRFRRLLPNLNINLREKDLQKNARITYCIKKPRVLR

SEQ ID NO: 5778 - protein, 41 aa, synthetic construct
WLKLYNKLFKYYKPLYATDAVDLKQRHSKATIRSRKRLRRA

SEQ ID NO: 5779 - protein, 20 aa, synthetic construct
YFRLLRRLLKWLTKKRLFME

SEQ ID NO: 5780 - protein, 36 aa, synthetic construct
RMRLYHRWWKKICKKLACAKQQWRRDYLWWLLRLLG

SEQ ID NO: 5781 - protein, 34 aa, synthetic construct
KIKMFCKLYRKWRQKACNRLQLLEPWLLPLRALF

SEQ ID NO: 5782 - protein, 35 aa, synthetic construct
LYKFLSRLMKKYRRWKLRAKMRCILADRAKADVLR

SEQ ID NO: 5783 - protein, 46 aa, synthetic construct
FLKFFKKFIRIYKKTAVRARMAKRWACYAALLYTRGAAKRLAVRTA

SEQ ID NO: 5784 - protein, 31 aa, synthetic construct
RMKLLQRFLKIFPHAILKLDRAMFYAKMRLA

SEQ ID NO: 5785 - protein, 64 aa, synthetic construct
KYRLWRRFFRWIKTEKTEAVTLEAKKSLRALLGKKAHCNRYLLKVHLMVSRFYHLKLALAKYKL

SEQ ID NO: 5786 - protein, 54 aa, synthetic construct
RYKILRKMMKKWHTHARCRPLLARNLDAKGLNHFALAALKPAKSQQDILKKASW

SEQ ID NO: 5787 - protein, 36 aa, synthetic construct
LIKYFRKMLKFLCSKHKKCAEKMLSAAVRKNKAVAL

SEQ ID NO: 5788 - protein, 38 aa, synthetic construct
RWRMLPKLLKWLPKYAFSSILQLAKNLLKLQRWAKRQW

SEQ ID NO: 5789 - protein, 34 aa, synthetic construct
KFRLFCKYYRKLQSADGKHRLELAAKLIASEKKL

SEQ ID NO: 5790 - protein, 25 aa, synthetic construct
KLKFLCKIFRYMQNACKRALRPLRI

SEQ ID NO: 5791 - protein, 94 aa, synthetic construct
KFKMICKMLKKMKTCQLRRLKKRPGPNKRRAEAFPATMFKAPRDAWKLCPKRWLEERALAKQMAAKKPALHLIMLAFRRCAKKKLCAGGLKQQA

SEQ ID NO: 5792 - protein, 35 aa, synthetic construct
RIRFLKKLWRRLRRRLKPLHALAHIAAAEFCRAKI

SEQ ID NO: 5793 - protein, 38 aa, synthetic construct
KFRLWKKLLRFMRRALDAMSAAMHGMKLHRGRINVNAL

SEQ ID NO: 5794 - protein, 47 aa, synthetic construct
KLKLIKRMYKWFKRRACKLYLGAFKMRVMAILYSPDNWEAALKELRK

SEQ ID NO: 5795 - protein, 24 aa, synthetic construct
FMRLLKRLLRRISTLKLQRIKHSQ

SEQ ID NO: 5796 - protein, 55 aa, synthetic construct
RYKYLPRLMRKLPRRAKNGHQCALKTTRGYRHKRALAAYAGAKAYVQAIAMLIRE

SEQ ID NO: 5797 - protein, 60 aa, synthetic construct
LFRLLRRIFKIMKRCLTRARRLAARLAGAPRKRAKMMRFVEKALLHVQKVSIAAKMKEII

SEQ ID NO: 5798 - protein, 31 aa, synthetic construct
KLKLIKKFFKIIRNLVEHYRSRLAARCKVAA

SEQ ID NO: 5799 - protein, 32 aa, synthetic construct
KFRIIKRLYKMLNCRLEARAKRKCLLRAMAGS

SEQ ID NO: 5800 - protein, 45 aa, synthetic construct
LFRLMTRFLRKLRPAFEMSKKDMRAHRAYDKGLKATLKRKERAKL

SEQ ID NO: 5801 - protein, 36 aa, synthetic construct
RLKMLSKLFKKLNKYNRKASSCRKYTRFLSFADLQA

SEQ ID NO: 5802 - protein, 33 aa, synthetic construct
RLRLLSKLFKRWRKQPRAWLGLSLDAAQDARLK

SEQ ID NO: 5803 - protein, 43 aa, synthetic construct
KLKYYPRMLRKLKQIQALAFLKYNSCRKRKRWAQNRAATHAYR

SEQ ID NO: 5804 - protein, 39 aa, synthetic construct
YFKFMSRLIRLLNSRLKYMLRRRYKAHRALANCAAERAW

SEQ ID NO: 5805 - protein, 48 aa, synthetic construct
KMKFFKRFMRLLNKLLHNRYKSNLASSWRTSADARKPMAMLLALFLAR

SEQ ID NO: 5806 - protein, 38 aa, synthetic construct
RWRYFNRLFKFLRNLAGCCALTFIRLKHPLRRVRLAAG

SEQ ID NO: 5807 - protein, 78 aa, synthetic construct
KIKMMKKMFRRFSTPWRARAARSERGWLAVLQRKAPLPRFGLLFKWIRKCWLARLRRYLRAREDPPARHSRRLLTAQA

SEQ ID NO: 5808 - protein, 25 aa, synthetic construct
YLKFWKKFLKLIQTEGQAAALSRRL

SEQ ID NO: 5809 - protein, 29 aa, synthetic construct
WYKLLKRLWRKIRKALAARLARYKKSLWR

SEQ ID NO: 5810 - protein, 21 aa, synthetic construct
FLKFLRRLFRKLKRHGALFDA

SEQ ID NO: 5811 - protein, 40 aa, synthetic construct
KMKLLQRLMKKWRKALACLWELLHMKKRSKCAVTAQKIAL

SEQ ID NO: 5812 - protein, 87 aa, synthetic construct
LFKFFRRLYRFFKRERLRAGLASRHITKNCKIAMKLAANNAMPARPEKKLMRQCAQMRKIARWSGWAAKKHCELRKAAHSADALRKE

SEQ ID NO: 5813 - protein, 31 aa, synthetic construct
LFKWMRRFLRLWRRILKAELMKDRAMLSTDA

SEQ ID NO: 5814 - protein, 22 aa, synthetic construct
RIRLMKKLWRKMNKAAKASLAV

SEQ ID NO: 5815 - protein, 33 aa, synthetic construct
RLRYLRRWLKRWSNDMLKKLLRGGLRIALERKL

SEQ ID NO: 5816 - protein, 81 aa, synthetic construct
WLKMLKKLFRKLKHKLLKPVANARLCYLQNLQDRRRDTRWWCKLDFACYALKAARLHMHKGVKLHGGNSRQLAALLVLLLY

SEQ ID NO: 5817 - protein, 47 aa, synthetic construct
IMRFFRRLFRLLKRNKVRCLLLAKNKEANMQRFDFLLACMEAKARSW

SEQ ID NO: 5818 - protein, 52 aa, synthetic construct
RMRMYRRFYRMLKRAMARLAEAKLRTSDHRHFLRPQGWAVAALTKRKANLVV

SEQ ID NO: 5819 - protein, 29 aa, synthetic construct
IWRILRRLMKKLKRRYQSLMALRGCALAP

SEQ ID NO: 5820 - protein, 32 aa, synthetic construct
FMRLLKRLFKRMCKYEKRKLLWKAMQKLLAEF

SEQ ID NO: 5821 - protein, 27 aa, synthetic construct
LFRLLHRIFKFIRKLRHAMKYLRACDE

SEQ ID NO: 5822 - protein, 40 aa, synthetic construct
ILRLWRKIWKKWRRQMLYKGALIKMRFPRAKFLAWEVAQL

SEQ ID NO: 5823 - protein, 32 aa, synthetic construct
LLRFFRKILRKIHRKLVKYLLLQGRWHGLKLP

SEQ ID NO: 5824 - protein, 37 aa, synthetic construct
KLRLLKRFWKLLKQFTAAIRRHGWKPFRGGNLYKAYK

SEQ ID NO: 5825 - protein, 46 aa, synthetic construct
RLKILTRLLRRIKKNLLKLLLQVLVAHLNLGAIKAMRSFRYRNHPL

SEQ ID NO: 5826 - protein, 99 aa, synthetic construct
RLKIFKRLFRFLKTFLPQLRADKDRARGRDYKSAALGCLQSGACWWCCRRALKGHLRSWSATKHKAKRSWKCRKALVLRMLLKDARHTAYRGALRKKPA

SEQ ID NO: 5827 - protein, 78 aa, synthetic construct
KLRLFCRMLRKYRSAKISANCTWVSYCRVYAPLLLFSDRENKKAMLLKRPDAHRKGPREALYLRRAKKGRPLAKADYK

SEQ ID NO: 5828 - protein, 67 aa, synthetic construct
RIKWFRRFWKKIRQGLALHRAFLFGRKWRCLLKYRLVTNLFSLLNRQSKRFTMLKRLATNALLLLKK

SEQ ID NO: 5829 - protein, 29 aa, synthetic construct
LIKYYRKYWKRLRKAARTLSAFAAISTNY

SEQ ID NO: 5830 - protein, 84 aa, synthetic construct
KMKYWNKFYRRLPRAAARRHPAALWRMMWALHLRTAYKLVLSILDRRRQGGALFKEARQAIGRAKFKRNATAAHIYAALAAMIK

SEQ ID NO: 5831 - protein, 31 aa, synthetic construct
KMKFLHRILKMWRKCKKTAACACQFLLEKKL

SEQ ID NO: 5832 - protein, 45 aa, synthetic construct
KYKMMRRLLRRIPRAKCAYALPGETYTAGKPKAWRKRAMAARNCI

SEQ ID NO: 5833 - protein, 28 aa, synthetic construct
RLRLFTRFLRKLKRAADWAQKRKASRAC

SEQ ID NO: 5834 - protein, 76 aa, synthetic construct
RLKLWKKLMRRLRKHHQPKATRLPSVLRAASLHEDIAFSCAGKVGNWAAKRLFRDPNEKKVAAPARWRCVRKKGRR

SEQ ID NO: 5835 - protein, 45 aa, synthetic construct
KFRIMRRILKRFNKKAKLLEKQWPLGLPAFGKRSLENKLWALASP

SEQ ID NO: 5836 - protein, 29 aa, synthetic construct
LYRLITRWLRKLTPCNLKWRATAWLRSRR

SEQ ID NO: 5837 - protein, 37 aa, synthetic construct
KFRWLRKILKFLRRAMGAYSRNGRAKRILHLASMKWY

SEQ ID NO: 5838 - protein, 42 aa, synthetic construct
RFRLLKRLLRWIPRALNAAWHKRLRLRSVCRSAAYGKYKYLV

SEQ ID NO: 5839 - protein, 72 aa, synthetic construct
MLKLLNRFLRRFRKLTCLWLVACPRAYAKQAMHKNIYGARHLKPALGKWKTKIHRMVALALYQAEKAEYRAL

SEQ ID NO: 5840 - protein, 90 aa, synthetic construct
ILKLFKKFFRKIKKADYDLALEVKRKLRNNWACRKLKNAALAKAKPCLRTLRMGRKKNYPTKTAGGAPLLEKAHLRLANLLLKAAIDRLR

SEQ ID NO: 5841 - protein, 43 aa, synthetic construct
KLKLLRKLLKYIRKVQLAAKRTKAASLRLFWADFQIFYVEHRM

SEQ ID NO: 5842 - protein, 94 aa, synthetic construct
IFKLFRRLLRRWRKAQYAKFCGVQLTMAFAHHLKWKLAFRLKLLARAKAKWVFREGDQPQYLAKKWARQFRRAKGLKRKRHLMAARAAYRKVMK

SEQ ID NO: 5843 - protein, 54 aa, synthetic construct
KMRLICRLWKRWRRSKLMHCGPAGALSLKLERARYAEAKGLAKEDQALTRWKMA

SEQ ID NO: 5844 - protein, 36 aa, synthetic construct
RYKLWNRILKFFKPGRRRKADAAWLRKLLLIKHMQW

SEQ ID NO: 5845 - protein, 20 aa, synthetic construct
RYKLLKKLFRLLPKQLIDAD

SEQ ID NO: 5846 - protein, 21 aa, synthetic construct
MWKILKRLLKRMRKWCALTNN

SEQ ID NO: 5847 - protein, 43 aa, synthetic construct
RMKLMTKLLKMLRRNAARHDKLKNKRTAKKPARDERARPAAGE

SEQ ID NO: 5848 - protein, 80 aa, synthetic construct
ILKFMCKMMRKWKKIALRRHEQLKKLLFLGLGKRHKALHTPVLRVDILFWLTRLRLLRRKMDAKKLWYVKCADRRKGKQL

SEQ ID NO: 5849 - protein, 23 aa, synthetic construct
KLKLLRRFLRWFHKIPEAARCYL

SEQ ID NO: 5850 - protein, 40 aa, synthetic construct
RFKLLRKMFRKIRSAQDCKAPMAAAAKAAYIARPAEKPKF

SEQ ID NO: 5851 - protein, 26 aa, synthetic construct
RLRFMRKYLRRMRTLARGTYEWCAAL

SEQ ID NO: 5852 - protein, 36 aa, synthetic construct
LLKIWKRFFRWLKRALWFQYAFRAQVAARWSLLYKR

SEQ ID NO: 5853 - protein, 98 aa, synthetic construct
LFRMLTRFFKKWKRLCLRNILKVAASLKKPKGVKVENYLLCACCEILQELLIAAKLKKCIAKCRRLLCQMMAPKNKKISEKRLFKLFPHKKLAAIKAA

SEQ ID NO: 5854 - protein, 44 aa, synthetic construct
LWRILRKLLKFLKCVAKQKAVAAAGAARVSQTKRAEARVVRVLK

SEQ ID NO: 5855 - protein, 43 aa, synthetic construct
RLRFLSRLYKWWRKSHKRLELHAKAVTRARLAACSHIREAAKR

SEQ ID NO: 5856 - protein, 71 aa, synthetic construct
FYKLYKRFFRLWKRARDGHKKWALAKMIAALYSFGRYLLQAKLAAAQKKDKLGEKHLDAKARAGWVYKAKE

SEQ ID NO: 5857 - protein, 40 aa, synthetic construct
RLRIFRRIMKLLNKHFMPKVRDYALWREAFLARKLARLIY

SEQ ID NO: 5858 - protein, 63 aa, synthetic construct
KYKYLKKYYRRFRPLRTWKRATSEIKKDWCKKNAAARHRLAAQLWNKALKVWKLVILRANQAT

SEQ ID NO: 5859 - protein, 34 aa, synthetic construct
MMRLIHRWLKWMRRFQASPALFLMAMEKARARRK

SEQ ID NO: 5860 - protein, 69 aa, synthetic construct
MFKLLNRLWRMLKRNAFIEWVKVAAVKAPVKKAAKSAEHLAALLFLFLHCWKLKAKMSRAKRLKADEKY

SEQ ID NO: 5861 - protein, 35 aa, synthetic construct
KLRLLRKILRFFRQVAAALPKRRMLMEQWRLRCFD

SEQ ID NO: 5862 - protein, 64 aa, synthetic construct
RLRMWNKMFRFLSRDRKNAQKALGWMRLRRLALMEGASGRGGSKWTAKLTKKRRCLRASMKLRD

SEQ ID NO: 5863 - protein, 86 aa, synthetic construct
YFRWFRKLLKKLSHSEVLPFKALQNWLLAPHKLLALPLKKVKKRAAYELMYEAKVRLMRRQAKKRSNKPVLCRAINNECHRRQAAL

SEQ ID NO: 5864 - protein, 32 aa, synthetic construct
RWKIWRRLWRKINKRPPNALLARAALALRMKT

SEQ ID NO: 5865 - protein, 58 aa, synthetic construct
RLKYLKRFLRLLTHICMDYIALCCKLKIKKKIRILNMRRCDLEKHKRALATLCVIKKY

SEQ ID NO: 5866 - protein, 27 aa, synthetic construct
WWKLMTRLLKWFRQNRALFLCRLARKK

SEQ ID NO: 5867 - protein, 36 aa, synthetic construct
LFRLMSKFWKLFPKAYHLLLHKELKGLRAKCFPKFL

SEQ ID NO: 5868 - protein, 38 aa, synthetic construct
KWRLFRKWFKRWRRLKHLLRLERAMLFKPLGLCLAQAY

SEQ ID NO: 5869 - protein, 60 aa, synthetic construct
LLKLYKRMLKKITTDEAREELAGLRKANQAVACMKRGKIGMADLRSAKSAKMLQMNRMAL

SEQ ID NO: 5870 - protein, 66 aa, synthetic construct
WFKFFHRLMRMMRTYTARRKLRLPLRKFLRRKKAKKLSLCKSAAYKKMLQQRAIADGAKNFHLLRL

SEQ ID NO: 5871 - protein, 32 aa, synthetic construct
KYRMLKRLLRKYCKMGEKASSPRTPPLLTLAK

SEQ ID NO: 5872 - protein, 26 aa, synthetic construct
KMKILKRLFKKFKKQLAPQQADSLPA

SEQ ID NO: 5873 - protein, 44 aa, synthetic construct
YLRLFRKLLKILPSYLKGAQRAKEKKIICYKLAYLTGRLSLRNK

SEQ ID NO: 5874 - protein, 54 aa, synthetic construct
FLKFFCKYLRMLKKCMLLLRTLEWYRAIPLRAEKPYCHRGLKAAKIPWKARADR

SEQ ID NO: 5875 - protein, 48 aa, synthetic construct
KFRLLQRWFKWFKKRFKRKAADCLINLAMKRALHILVSDVRKWARTRL

SEQ ID NO: 5876 - protein, 29 aa, synthetic construct
KLKFLSRFMRRWSPLLHRLRPAFFQLALE

SEQ ID NO: 5877 - protein, 27 aa, synthetic construct
LIRFLKRFWKKLQTAKFHYALEKSPLR

SEQ ID NO: 5878 - protein, 49 aa, synthetic construct
RFRFMQKLLRLWRKAAELAANALRKDFQKQAVPYFYTIMGRKFKNKKAL

SEQ ID NO: 5879 - protein, 84 aa, synthetic construct
FYRFFCKFLRKLCRAAIAAGKHTKARAKHAARHSKRFLQGQKHYRELTLFARAKGLRTKRASPALKALKQNERNFIANFAILLA

SEQ ID NO: 5880 - protein, 26 aa, synthetic construct
LFKFLHKWLKRFKRNGSLAKLAKIFH

SEQ ID NO: 5881 - protein, 40 aa, synthetic construct
RIKLLKKMFKKYKTPRARLPFALHHLAYARWLCTQVWLYR

SEQ ID NO: 5882 - protein, 24 aa, synthetic construct
FLKLFQKFFRLLTQKALHKAKIKF

SEQ ID NO: 5883 - protein, 56 aa, synthetic construct
KFRFLRKLWKKYKSYAKKWKLAAQAIFCLAWLYARAALRQVIDANCGDALEKLGKE

SEQ ID NO: 5884 - protein, 60 aa, synthetic construct
LIRLLCKLIKKYRCLQTSEARQRRLYVYAKYALLAAHKNLRLLMRMRYGDKCKRCFNRFA

SEQ ID NO: 5885 - protein, 24 aa, synthetic construct
RLKLYHRLLKYYKKILKYNKLFDT

SEQ ID NO: 5886 - protein, 24 aa, synthetic construct
LLRWMKKLFRKLNKAPCRLAMKKE

SEQ ID NO: 5887 - protein, 28 aa, synthetic construct
KFKWLQRLLKKYRKLVRCWMYAQRALPA

SEQ ID NO: 5888 - protein, 25 aa, synthetic construct
KLKILQRLMRFFRRAVIANNAALRH

SEQ ID NO: 5889 - protein, 61 aa, synthetic construct
LYRFFCRYLRLFRKRAYAVSLRRRARAHNALGLALAIDSRKMAWRHRHKANKEILDRRLHP

SEQ ID NO: 5890 - protein, 36 aa, synthetic construct
RLKYMTKWLRMYNKKWLGKALRIKIALYALKLTSAF

SEQ ID NO: 5891 - protein, 89 aa, synthetic construct
RIRFLKRMWRRWRQIAQSLRAEIAKLKIKSETYCLQKMKAMTAERLLILLFAINSNALALWTEKLARKITKSAAKPARTKCALGAYHAR

SEQ ID NO: 5892 - protein, 33 aa, synthetic construct
KLKFLRKIMKRFTRSLYKRFLPQLLSLLIVYRK

SEQ ID NO: 5893 - protein, 25 aa, synthetic construct
RLKWLRKWLRKFCPAQCMVRAHLLY

SEQ ID NO: 5894 - protein, 41 aa, synthetic construct
MIRYMKRLMKYYSKGAAALNGCRKRRLLTLARVRCKLGKRL

SEQ ID NO: 5895 - protein, 56 aa, synthetic construct
RLRLWRRWFRILSKWHYESKFRRLKAALSEAVNRAHLRANTMKRLRLYADVWKKKQ

SEQ ID NO: 5896 - protein, 69 aa, synthetic construct
RFKWYRRIYRRMRTRSAKAAALKLKWRPQLLVKAANGHAVAHKRCLHLAQCCELRKPGELHRKLWFVAK

SEQ ID NO: 5897 - protein, 28 aa, synthetic construct
FIRFIKKFLRFLRRAAIKSLPANLKPRD

SEQ ID NO: 5898 - protein, 54 aa, synthetic construct
KFRWWCRFLKMIRNRGRRRLLRLAAFYALTNRMSKHLWYARARDQMRRDAKAPR

SEQ ID NO: 5899 - protein, 23 aa, synthetic construct
RLRFLTRFLRWLRTSKSEIRCAA

SEQ ID NO: 5900 - protein, 44 aa, synthetic construct
KFRYFQKFLKRLCKMEESLKALAKRACWRHDKIQAKNAAARAWA

SEQ ID NO: 5901 - protein, 54 aa, synthetic construct
KLRLFRRLYKKICRMYPARPLGKREIHCKLKAMLLKPGHKRLALRKADHKAFVL

SEQ ID NO: 5902 - protein, 67 aa, synthetic construct
RLRFMNRMYRRFRKGVRRAFIARLILNWALIRVASLMYATATAFKAKRHLLWAKITAKARPVRKKKK

SEQ ID NO: 5903 - protein, 92 aa, synthetic construct
KLRYLKKLLRKIKRGQGKQGSFAALNAALKIKFFGLVKVLKVSADAATLLPWRVARYKARTYAERFKLENFKLEPMATKFLWAGELLARDLP

SEQ ID NO: 5904 - protein, 37 aa, synthetic construct
RLKLWTRWLRLMRKRLIEGLKLLLVKNAGTFRGIWAK

SEQ ID NO: 5905 - protein, 25 aa, synthetic construct
RLKLMTKYWRLMNKLALKSEKVPFK

SEQ ID NO: 5906 - protein, 40 aa, synthetic construct
KYKFLRRLFRWLKRLQDRRAPMIWALSAKRERSNSLLILK

SEQ ID NO: 5907 - protein, 51 aa, synthetic construct
LFRWLCRFMKWWTRRAKALILAPTASRTRLLAILAAIGARANVKVSAKKER

SEQ ID NO: 5908 - protein, 34 aa, synthetic construct
RIKYLTKMLRKFHTASKAYLIYKQLDAAASKLNL

SEQ ID NO: 5909 - protein, 31 aa, synthetic construct
KLKFLHKLIRRLCHRRSKIMRVAHAAFAHAK

SEQ ID NO: 5910 - protein, 30 aa, synthetic construct
LWKLYHRLIRFLCQVRRIGARALLKRHRLG

SEQ ID NO: 5911 - protein, 40 aa, synthetic construct
KFKFYKKLMKFWRKLNAKARAKCPNYLPLQKRTQALRKAI

SEQ ID NO: 5912 - protein, 54 aa, synthetic construct
YFRLWRRLLRRLKPQDAEPANGNVRARKRFVLLLTWCLRALMFCYAAKYRKFYA

SEQ ID NO: 5913 - protein, 34 aa, synthetic construct
LLKLLRKYLRLFPKRGISKIKRKLAELLTPYYAD

SEQ ID NO: 5914 - protein, 24 aa, synthetic construct
KIKILTRFLRLLPNIEAAAQRAKM

SEQ ID NO: 5915 - protein, 47 aa, synthetic construct
RFRLLKRYIRLLCKLRALAFYHLRRLLKLFLMAYLLCMSIRKWCKKS

SEQ ID NO: 5916 - protein, 42 aa, synthetic construct
KFKWITKLIKKFRHKRLWLLTNNRAKQERRMHALMNLKAKLM

SEQ ID NO: 5917 - protein, 23 aa, synthetic construct
FFRLMRKLMRRLQKAEPHAELIR

SEQ ID NO: 5918 - protein, 51 aa, synthetic construct
LYKWYRKLYKFLQKPRPLDGACVHARGKKDLYHKRLWKSIRAAKAKRWGLL

SEQ ID NO: 5919 - protein, 65 aa, synthetic construct
FLKLFKKLFKKYCRRRPLLDKACFNTLLDKVTRKLASADNPYLGRGANLRRCTFRMARFRYLCKK

SEQ ID NO: 5920 - protein, 50 aa, synthetic construct
WLRLFKKMYRKLHNNLDKRGAAFCDLKVALSKMTMKPATCKKACKAYKAA

SEQ ID NO: 5921 - protein, 66 aa, synthetic construct
LFRLFPKYWKWLRKYTPKLIMQTGHKRIAKQTKDLRRAPSLDKAHRAARERELKLKYYEALLRYAR

SEQ ID NO: 5922 - protein, 27 aa, synthetic construct
KYKILPRMLRRLKRGLWHLSALQQLAK

SEQ ID NO: 5923 - protein, 49 aa, synthetic construct
RLRLFQRMWKRIPKQHHLAYQRILSTRSKAKALALVRKYAKANTLDILY

SEQ ID NO: 5924 - protein, 73 aa, synthetic construct
KWRWMKRIFRRMSKNVYARLNSLILAARLSLRKKHAQGPTLLQHKWKIAAFLKRHACLRRRATMKAWGALAQN

SEQ ID NO: 5925 - protein, 43 aa, synthetic construct
FIKILRRWLKLITSARAGKHKKLALWMMALARLLYEIAKNRCK

SEQ ID NO: 5926 - protein, 21 aa, synthetic construct
MWRFWKKFLKLLPRHLNQKKA

SEQ ID NO: 5927 - protein, 22 aa, synthetic construct
IFKMLNKWLKKLRRAAGFSKLP

SEQ ID NO: 5928 - protein, 29 aa, synthetic construct
RYKLLRRLWRKLNKLDKKFLLGHTTWPDY

SEQ ID NO: 5929 - protein, 53 aa, synthetic construct
RFKLLKKLIKRFTTLRNVLLKLKGNGLKTRAAQNAALAVIWRRAKIMPHLWKR

SEQ ID NO: 5930 - protein, 27 aa, synthetic construct
LFRWYSKLLRRICRAHHRGAMRLRLQR

SEQ ID NO: 5931 - protein, 60 aa, synthetic construct
KMRFFKKWMRRMNHKPRMLKLAAAYRVKVLSAAVADMALASAKARVMPVVWTKLGAKRRA

SEQ ID NO: 5932 - protein, 28 aa, synthetic construct
YLRILKRLLRWLHRGDIQAKNQKHRALC

SEQ ID NO: 5933 - protein, 37 aa, synthetic construct
YLRWWKKLIKLLRKLTDKDRWRYTLAGILKNRKYLPC

SEQ ID NO: 5934 - protein, 65 aa, synthetic construct
LYRWLRKLLRKLKPQMWLRAVPTKLKFGKCLKHAPWSAKLMVCKTKAALMLKSKMWKPQHMASRK

SEQ ID NO: 5935 - protein, 31 aa, synthetic construct
KWKLLRKLYKRLKREWCTADFLFYLLCLRLA

SEQ ID NO: 5936 - protein, 34 aa, synthetic construct
MWKLWKRLFKFLQPRPLDIFAFHKLAACAAKRRL

SEQ ID NO: 5937 - protein, 37 aa, synthetic construct
MLKMYRRYFKLWCRARWCAARMQLAKGYANRHRLGLR

SEQ ID NO: 5938 - protein, 29 aa, synthetic construct
RYRFLPRFLRRFRCAVSLAATNWKALKQK

SEQ ID NO: 5939 - protein, 41 aa, synthetic construct
RIKLFKKIIKMYKCYQAHCLLKLAAAMIRLKCKCGRYSRLR

SEQ ID NO: 5940 - protein, 26 aa, synthetic construct
RLRFLKRLWKKLKRCAVPTEYWYAAV

SEQ ID NO: 5941 - protein, 54 aa, synthetic construct
WLRWIQRLWRKLNKLYLGVALKKLFYKKRSARKEWNEKCLLAVFPAIPQRRLNK

SEQ ID NO: 5942 - protein, 37 aa, synthetic construct
RFKWLRRLLRRLCRDNWDKQAACNAHKHRYLARKAFH

SEQ ID NO: 5943 - protein, 34 aa, synthetic construct
YLKFLRRWMKKWKQKKRLALLLFHMADRQLKLAA

SEQ ID NO: 5944 - protein, 27 aa, synthetic construct
RLKLLQKLFRLLCRCIKEKLMQYQNAW

SEQ ID NO: 5945 - protein, 39 aa, synthetic construct
RFRLFKKLLKKLKRMSLRMQRNRKLYLYCANARANWLGE

SEQ ID NO: 5946 - protein, 28 aa, synthetic construct
FLKYFSKLFRLFRKRLCFYCAKNRLASR

SEQ ID NO: 5947 - protein, 29 aa, synthetic construct
KLRLFHKLLKRLKHLDRMSTLRAAVSEQK

SEQ ID NO: 5948 - protein, 22 aa, synthetic construct
RFKFLRKLLKRLNRMPCYIAAR

SEQ ID NO: 5949 - protein, 63 aa, synthetic construct
FLRFLRRFLRWLRKCAAADQRSEARLGLLLRELDAIARYARWCRGYRVNQAYRLRTSCHVLLQ

SEQ ID NO: 5950 - protein, 20 aa, synthetic construct
KLRFLCRLYKWLSKYWLFKK

SEQ ID NO: 5951 - protein, 38 aa, synthetic construct
LLKYMHRWLKRLQKHIITKRAAFPLKGQLSKRKAAMAF

SEQ ID NO: 5952 - protein, 25 aa, synthetic construct
MFRLLKRFYKWLRRLLLGRRTRAAI

SEQ ID NO: 5953 - protein, 49 aa, synthetic construct
RLRLFRRLLRKFPRLECLFPKGAKYILRTQWQTDMAALAKVKKLETLGS

SEQ ID NO: 5954 - protein, 38 aa, synthetic construct
RLKLLCKLYKKIRNSIAMRIAMLRCLFSDHAGLRRTKQ

SEQ ID NO: 5955 - protein, 36 aa, synthetic construct
KLRILQRFMRLLRKCLIDQEVARYCPALKLPRGHKR

SEQ ID NO: 5956 - protein, 43 aa, synthetic construct
RWRFLRKIFRKFSRKAALDAYRAIYASIKLKLRLARKTYAYMW

SEQ ID NO: 5957 - protein, 27 aa, synthetic construct
KLKYLSRFLKFLNKRALPSMFKMDRAA

SEQ ID NO: 5958 - protein, 63 aa, synthetic construct
RMRYLKKMFKKLNCKWRLLWRRLLRADAAAVQRRIRTDEYHPTVRELIAARELKLGKRAMLLN

SEQ ID NO: 5959 - protein, 58 aa, synthetic construct
IWRLFQRILKLMRKLCNIIKRVQFFPRMVRAAKLLPACAYRGTRRIKAFRLLRKELAR

SEQ ID NO: 5960 - protein, 21 aa, synthetic construct
KLKLMRRLYKLLRHCGKNANW

SEQ ID NO: 5961 - protein, 74 aa, synthetic construct
FIKIYRKMLRFLTPRLYKARLDAVGAIKAKLRRRMGRLKWNIPHLLRNYLHRNWRLLKARHKLSDMDRIIQKKK

SEQ ID NO: 5962 - protein, 76 aa, synthetic construct
LYKLWSKFLKLLRRLVLRKAQAKFCTLGTKHLKTSKMTMLERCKCRRTRGLLASAAHKERMMKAHAWKELTELALQ

SEQ ID NO: 5963 - protein, 33 aa, synthetic construct
RIRMLTRWLKKLRRRTAAKYYARLRATSKWAIT

SEQ ID NO: 5964 - protein, 40 aa, synthetic construct
FLKILKKLFKYIQKILKQVLMQRGRKAARLAGWLALRKIV

SEQ ID NO: 5965 - protein, 40 aa, synthetic construct
YYRWLRRWLRMYRKPTREKAGFKDAILLKRLLRYTARLNY

SEQ ID NO: 5966 - protein, 30 aa, synthetic construct
FMRYIKKLIKLLSKAVRKATGNRWKPLSKA

SEQ ID NO: 5967 - protein, 32 aa, synthetic construct
FFKLLTRLLKFMCHLLASRLQAKAKTSRAIKN

SEQ ID NO: 5968 - protein, 56 aa, synthetic construct
RMKLFRRFLKLLRSHAKKRVRAKQCALVSHRDPKSKVLYMKLARPHKLWKFYYDDA

SEQ ID NO: 5969 - protein, 24 aa, synthetic construct
RIRLLKKLLRKLKRCKGMQLLCAR

SEQ ID NO: 5970 - protein, 36 aa, synthetic construct
RMKFFKKLWRKWTCSAFFRFALRVLAKPHAAKGAER

SEQ ID NO: 5971 - protein, 27 aa, synthetic construct
WLKLYRKLYKWLRKCALWLQMRHCKIF

SEQ ID NO: 5972 - protein, 73 aa, synthetic construct
FMRYLKKLFRLIQKRKKKVTKAEPMPAGAYKADTESWALNRRWALWHRRKKKKRLELSQMLFKWGAKHLILKL

SEQ ID NO: 5973 - protein, 50 aa, synthetic construct
FWKLFRRFYRRLHQKLKRTTMPEPARWYWAKRKKLLALLLFMHGARASLH

SEQ ID NO: 5974 - protein, 33 aa, synthetic construct
RYKYYKRYLRRLKRDKVPLALAYIEMANLLPDR

SEQ ID NO: 5975 - protein, 27 aa, synthetic construct
FFKMFRKFLRKMKRTMLSQAAAGDLKL

SEQ ID NO: 5976 - protein, 21 aa, synthetic construct
RWRLMQRWLKLFRNLTAYIRR

SEQ ID NO: 5977 - protein, 56 aa, synthetic construct
KFKYIRRLIRYIRSLRAHLAARLLAAKKRLAMKTLRALIFLAAHRRICAAFKARKC

SEQ ID NO: 5978 - protein, 43 aa, synthetic construct
LLRYLCKFLRKYRHSAGHLGAKAHLTGWEQQKKLRLLSKQRDL

SEQ ID NO: 5979 - protein, 20 aa, synthetic construct
LLKIMKKFYKLLRKAEKWWE

SEQ ID NO: 5980 - protein, 70 aa, synthetic construct
LLRLIRKIFRKLNKLAYMRKASVWGTSVLDLLRKNTALRWLHKLRPPKLYARETLNLKCKVKPRLYIWLK

SEQ ID NO: 5981 - protein, 67 aa, synthetic construct
ILRLLSKFLRKYCKKVRVCECMIAAMALRCPRAEKKRAKGRLSVDYWPRPAYPLADLRRADARKKRS

SEQ ID NO: 5982 - protein, 30 aa, synthetic construct
KLKIFPRILRLLSRRKRQCFGRILLQRNPA

SEQ ID NO: 5983 - protein, 48 aa, synthetic construct
YFRYFSKIFRKIKKALALCEAKAAKEIKMPKLRDHLKMKCYLALRCRY

SEQ ID NO: 5984 - protein, 20 aa, synthetic construct
RMKLLRKMFRKLSCAASCAA

SEQ ID NO: 5985 - protein, 49 aa, synthetic construct
KLKYLCRILKIITTRIKAPARDQLDKCLLFCKAMKMKPAWLRGRLLKVD

SEQ ID NO: 5986 - protein, 27 aa, synthetic construct
RFRWFRKLFKRLPTNALRASEDALVQR

SEQ ID NO: 5987 - protein, 33 aa, synthetic construct
FIKFWRKYLKMLHCLLERRNSERLLLKATILRA

SEQ ID NO: 5988 - protein, 94 aa, synthetic construct
WIKLLKRLFKKLRSHWREGETLYAKKLLCELWKLWQLLIKKLARSAKSADFVWTLKKMLMKFQKAGRLLCALRSSQNLQPRRHKKMLLASREKL

SEQ ID NO: 5989 - protein, 60 aa, synthetic construct
RIRLYTKMFKFLKRRLTYWSGRDLDKIAMARKAAQGLILKKLAAKAEMFYNLTGIKKHKL

SEQ ID NO: 5990 - protein, 20 aa, synthetic construct
KLKMLRRFFRKLNKALGGNP

SEQ ID NO: 5991 - protein, 46 aa, synthetic construct
LLKLLTRFLKYLHRPYLMNRLRRGREAQEPLARWLMRFRLHRKCAD

SEQ ID NO: 5992 - protein, 38 aa, synthetic construct
KLKFMQRLFKRWRKLTPGKIAAPFVAPAIAIQKKIKRL

SEQ ID NO: 5993 - protein, 38 aa, synthetic construct
KLRFFKKFLRLWHNFAGNVRALLRWSRKAQFIKHYLRL

SEQ ID NO: 5994 - protein, 44 aa, synthetic construct
FFRFWTKLLRRFKRLLTLQMTKHKRKVLWAGGYLLDAFRAALLL

SEQ ID NO: 5995 - protein, 32 aa, synthetic construct
MWRLMRKLWKLLKSARDGLADCCKRRHIKAYD

SEQ ID NO: 5996 - protein, 26 aa, synthetic construct
KLRLFNRLIRWLKRNLLKAADQMNHR

SEQ ID NO: 5997 - protein, 52 aa, synthetic construct
RYKIFPKYYRRLKKFWHCLAACFFTRRAKLLHVQRKCALKEAMAKATRAKTK

SEQ ID NO: 5998 - protein, 21 aa, synthetic construct
KMRFYTKLMKKLRRALLAGSR

SEQ ID NO: 5999 - protein, 67 aa, synthetic construct
KIRLYKKYYRWFRRLARSKLRFPARKAKATWLSLAQRGWVVLAMARLLTCAARRTELTMRDMCMLWN

SEQ ID NO: 6000 - protein, 39 aa, synthetic construct
KFRLLTKIIKKWQQASQQRLKLRDAAARRRLLKALQFMW

SEQ ID NO: 6001 - protein, 62 aa, synthetic construct
LLRLLRRYYRLWRRTRRRFRTKCLADSIKKARKVFTDDNRDADLLRKALCLACWWLRPPWHR

SEQ ID NO: 6002 - protein, 40 aa, synthetic construct
MFKLFKKFLKLLNKLKLLWSFKRNDARMKGRASAVCCHHR

SEQ ID NO: 6003 - protein, 77 aa, synthetic construct
RFKLLNRLLKLMHTFTKWKLLCWMARLGTSIRLRLKNRLKNNVKLLNSHLRDLKLCHRRKLFFARNRRQLDHKPGTA

SEQ ID NO: 6004 - protein, 26 aa, synthetic construct
RIRLFSKLLRLFKRKHRASHTYQAAK

SEQ ID NO: 6005 - protein, 20 aa, synthetic construct
FIKILCRWIRKIPRRAAALH

SEQ ID NO: 6006 - protein, 30 aa, synthetic construct
KFKLIRKWIRWIRKDDLAACKSTYALDRLA

SEQ ID NO: 6007 - protein, 22 aa, synthetic construct
RLRFLRKLMRFFRKSCLAMLAK

SEQ ID NO: 6008 - protein, 50 aa, synthetic construct
RLRLMRKFLKRYKQIVRWFRNPRLDVAKAAAPEKRRDIAAYGPAHCKARI

SEQ ID NO: 6009 - protein, 47 aa, synthetic construct
KLKLLNKYYRRLRRANWSHQLCLATIRSERRSFYKNLCAKAAPRCCL

SEQ ID NO: 6010 - protein, 28 aa, synthetic construct
KMKWLQKLLRKFTQAKCPSFAKFLRLSA

SEQ ID NO: 6011 - protein, 39 aa, synthetic construct
KLKFFTRWLKRLNKRRYWCLAKARGAGNLWRFHANLKED

SEQ ID NO: 6012 - protein, 38 aa, synthetic construct
KLKMFKKMLKRMHTVLKHRQGYLAARMGRRLGHLDAKP

SEQ ID NO: 6013 - protein, 68 aa, synthetic construct
RLKLLHKLWKRLRKPLRARGLAKKCLESVLLQLLQDRPRHICVLMRAPRASSSHIVILKADAWATEPK

SEQ ID NO: 6014 - protein, 46 aa, synthetic construct
RLRLLPKILRRYTHAPMCMLKHAMAAAIAPRKPCLRARTSPKAKTR

SEQ ID NO: 6015 - protein, 32 aa, synthetic construct
KMKLLRKLLKKYRSKYKCAVAARASRTLAYLK

SEQ ID NO: 6016 - protein, 97 aa, synthetic construct
RFKWFKKLLKLFTPHVYMYLATLFSKKKKARLELALRAWGWLKAYAHQLRIRDKAQRNWPLLHKLKIAYKKINKLHLLVLNIHKLHRVLAFFAVALH

SEQ ID NO: 6017 - protein, 28 aa, synthetic construct
KLKLLQRLWKKYKSNAINLQTWLCLIKR

SEQ ID NO: 6018 - protein, 47 aa, synthetic construct
RFRLLKKMYKKLRKEKKAQKCGGGMCLKDIWALKLTALISAARLAAG

SEQ ID NO: 6019 - protein, 46 aa, synthetic construct
YMRLLHRMLKYFRRPAVRIHVKLAKQRKHLYQSKFKAAYARYLLHR

SEQ ID NO: 6020 - protein, 21 aa, synthetic construct
RWRFYRKFLRLLTQLRARNEP

SEQ ID NO: 6021 - protein, 63 aa, synthetic construct
KFKYLKRLYKWLKKTKHNNRCHGCLLQKCLRELLLAKALRRAILCDKTNDNLNRHHLFPRLTL

SEQ ID NO: 6022 - protein, 20 aa, synthetic construct
YMKFLCKLLKFLKRKAAKQA

SEQ ID NO: 6023 - protein, 34 aa, synthetic construct
YLKMFRKYLRLFNPKLKGRRAGQDVWQASARAAL

SEQ ID NO: 6024 - protein, 63 aa, synthetic construct
RYRLYSRFFKLIRNSALRFSKSAATTLLRSKTAAHSFERFRKKKPALHKLTLLRLNRKPLTPI

SEQ ID NO: 6025 - protein, 27 aa, synthetic construct
KWRYLTRLWKLLRHSLWRWARAAPCRP

SEQ ID NO: 6026 - protein, 29 aa, synthetic construct
KFRLFRKILRRLNPNKLLGLAANPPTWWK

SEQ ID NO: 6027 - protein, 57 aa, synthetic construct
KLKYWRRYFRLFNRHRYDFKLMAPKVKKEKLYLIKPDLAVAHAAANGDAAKLLARNN

SEQ ID NO: 6028 - protein, 36 aa, synthetic construct
RYRILQKYMRRLRNAASELAELLKSLIAYIKGAKQY

SEQ ID NO: 6029 - protein, 27 aa, synthetic construct
MWRLLRKFLKKFNKLCKLPESQKIAAR

SEQ ID NO: 6030 - protein, 64 aa, synthetic construct
LLKIYSRLLKWMKRPLTARYRKLRCLAKFRRRTLAISPKECVKLPYAAPMDDQAKARAPKLQRW

SEQ ID NO: 6031 - protein, 24 aa, synthetic construct
LWRMLKRIMRKIKNAWAQLPWARR

SEQ ID NO: 6032 - protein, 78 aa, synthetic construct
FLRFLKRWWRWIKKLRRADNIAHNWLSAGLLPIKGCAALNFMKKKFHAKKILTAACMALKKGRKEKRKLIVLPAAAGT

SEQ ID NO: 6033 - protein, 31 aa, synthetic construct
KLRLFPKLLRIYNRLRPKALLRTFVNWTRFR

SEQ ID NO: 6034 - protein, 40 aa, synthetic construct
FFRIFKKILRRLKKDAGALILHMYLFTKKKACRPKTTLWK

SEQ ID NO: 6035 - protein, 58 aa, synthetic construct
RLKFMRRWMKKFKCAARKLALRPAGLADIESLNDKLSKRAKYSLQPRRKLASLCCRFK

SEQ ID NO: 6036 - protein, 58 aa, synthetic construct
WMKLLKRFFRRLKKMAKLKNCARRLMKGLWRDFEKVEAYRCMHRKATNTLAAFALDMS

SEQ ID NO: 6037 - protein, 29 aa, synthetic construct
LWRFIKKFLRWWKSAVKKLEPEALRGVAL

SEQ ID NO: 6038 - protein, 42 aa, synthetic construct
KFKWFPKILKRLRKAADKKLHPGQKLRRRALLVWKFSKLAAS

SEQ ID NO: 6039 - protein, 48 aa, synthetic construct
RYRLFRKIIRRFCCCVLPLRACRKLGLAEQHLKLACKYKLFQKAKLLF

SEQ ID NO: 6040 - protein, 20 aa, synthetic construct
IYKFLKRYYKKFKKAFLAYA

SEQ ID NO: 6041 - protein, 71 aa, synthetic construct
RWRMLKRMFRKYKRMSKQFREFYALKPLVLRRHYAKLLDRLQAKEWKARRNAAAKKCLNMMCARQARTVLG

SEQ ID NO: 6042 - protein, 21 aa, synthetic construct
LLKLFNRLLKRFHSAYSARTQ

SEQ ID NO: 6043 - protein, 36 aa, synthetic construct
KLRIIPKYYRRMSRLQKLRRDWVNASNRCAAALLKR

SEQ ID NO: 6044 - protein, 51 aa, synthetic construct
KLKLLNKLWKKLRRVFAFHKEILQEMKYTFAWLWEGTLARKALLARWKWWA

SEQ ID NO: 6045 - protein, 61 aa, synthetic construct
RYRLFKKFFRKLRNLARSRRARADRRFLLKVGWIRDAKSKVSVAAQWKAQWRLLRGALHYT

SEQ ID NO: 6046 - protein, 43 aa, synthetic construct
MMRILCRLFRRLRRLVATHVRDALRPKLFNAAYRALASQKYMC

SEQ ID NO: 6047 - protein, 24 aa, synthetic construct
RFRMMKRIFRRLKKLAKIALATIL

SEQ ID NO: 6048 - protein, 40 aa, synthetic construct
KMKLLQKWYRKMKQNIAAKLHLGLQAREAAKHATLRDQRF

SEQ ID NO: 6049 - protein, 20 aa, synthetic construct
RYRIFKKLFRFLCRLALREG

SEQ ID NO: 6050 - protein, 26 aa, synthetic construct
RFRWYTRLYKLLRRYARKKAPDLAMV

SEQ ID NO: 6051 - protein, 41 aa, synthetic construct
KLRFFPRLLKLMTKKLEEHAARKFKRMWRSACPLLYCKKMM

SEQ ID NO: 6052 - protein, 49 aa, synthetic construct
RWRWWHRLMKRWRKKCAKLAMLFWCVRLLQKMEPNPLFLWKLLCARAPR

SEQ ID NO: 6053 - protein, 45 aa, synthetic construct
MMRMYSKYLRKFPRHRKAKLAAQCLCHTLKQPRHPFAARLLARRD

SEQ ID NO: 6054 - protein, 25 aa, synthetic construct
YLKIYRKFYRRLKKDWNAILFASRL

SEQ ID NO: 6055 - protein, 91 aa, synthetic construct
KLRIFRRIWKRWQTSSHVIRRSKKNNKYAVRPEARRIRYKPLVIKELALHHARLKANEPMLVIAQLWEKALKKFAARKKLKLGKRMALLYA

SEQ ID NO: 6056 - protein, 46 aa, synthetic construct
RMRMMRRFLRMWRRLAGAHYAAKAKCTKRNRDMDLDALKIYRARQA

SEQ ID NO: 6057 - protein, 33 aa, synthetic construct
LFRYYKRMWRKLSKRTWVVLLKKSAAAWDRLKM

SEQ ID NO: 6058 - protein, 32 aa, synthetic construct
ILRFLKRLWRKLRHRGLKSKQALTLLREVCCK

SEQ ID NO: 6059 - protein, 24 aa, synthetic construct
RLKFLRKFWRWLRPLLRKVLYPHY

SEQ ID NO: 6060 - protein, 42 aa, synthetic construct
RLRIFRKLFKKIRNALFPRAATIFDWPCRRKAKVRMRLLDWL

SEQ ID NO: 6061 - protein, 26 aa, synthetic construct
MLKMLKRIIRLLKKLQNVVAKKLDKC

SEQ ID NO: 6062 - protein, 30 aa, synthetic construct
LLRLIPKYYKRLKKLQAMTFRYSQRRHARN

SEQ ID NO: 6063 - protein, 66 aa, synthetic construct
RLKLITKFWRRYRPLAWHHNTARRPNLLIEFRWAHGADLNKKLNARDLKKDKARGLLKAVKAMKGQ

SEQ ID NO: 6064 - protein, 67 aa, synthetic construct
FMKWIRRFMKRFKCRREALPCHPGKSMLARVLLHGARKAAKRLFCAKLARDCRKANCHCRNDARARH

SEQ ID NO: 6065 - protein, 83 aa, synthetic construct
RWKFFKKLLRRFQRAHDPKKNKIEISKLKAMAALTAALPDKNGQAYLQKMDTPRKARDASRKKAAIAKLYLMKQITRIAFLLR

SEQ ID NO: 6066 - protein, 41 aa, synthetic construct
FWRFLRRFFRMLPQAKCNAWRARHKALALMASIKDAKRWAH

SEQ ID NO: 6067 - protein, 34 aa, synthetic construct
FFRYWSKLFRLWKRIDLRRILTLLKAIAKFYLAA

SEQ ID NO: 6068 - protein, 52 aa, synthetic construct
LLRFLRKLYKLFKHEARSAMAAKPLARHRLALMLIRHKRQRDSSVSKWHFAA

SEQ ID NO: 6069 - protein, 24 aa, synthetic construct
WFKFMHKLLRLLQKQRLKRKLRLL

SEQ ID NO: 6070 - protein, 44 aa, synthetic construct
MWRFIQKMMRLLRRAGAAKGAYDLKPHDRFLRAARRQMRRAKNL

SEQ ID NO: 6071 - protein, 36 aa, synthetic construct
KFKFWTRFLRFYHRRMKLLIAFILLLEFKAKACRDK

SEQ ID NO: 6072 - protein, 33 aa, synthetic construct
KFKLMTRIMKRLPKRAVMFRAQCKHSAALRGLR

SEQ ID NO: 6073 - protein, 47 aa, synthetic construct
LLRFWSKYFRKFRKDRRLAWARRAINARNIKALKGDRLQAYLLCRLQ

SEQ ID NO: 6074 - protein, 80 aa, synthetic construct
LWKLMCKLLRLIPTKIARQMRRIIFGKAEAAQTLPRKYTVAALRSPKRGMRAKARFSWLKKCLRKAALVRKMGYNFLKAL

SEQ ID NO: 6075 - protein, 56 aa, synthetic construct
RLKLLRKWWRFLRRRARKEPKEKALCKSGSMAFWDQLKTKVNAQVKKDKLLALRHP

SEQ ID NO: 6076 - protein, 40 aa, synthetic construct
RWRLYRKILRLIKPIPPALTRKKSCFAPAAPLSLKTKFMK

SEQ ID NO: 6077 - protein, 63 aa, synthetic construct
RFKFFRKLLRKYCNRRRANRARLGTRRLTAALMANAALAPSLRSRLVGAQKARMLHNLGPHAQ

SEQ ID NO: 6078 - protein, 37 aa, synthetic construct
KFKLLKKLFRFLKRAARKGLYQSKLGVYLRLNITKAL

SEQ ID NO: 6079 - protein, 62 aa, synthetic construct
LFKWIKRFYRLFRCLHGYKKEALRLLAGNKREPRIALPRVNQLTARRAHLQALQKRARGARA

SEQ ID NO: 6080 - protein, 34 aa, synthetic construct
KLRFLRRYYRRWPTKQLHMAMRKASLAYLLLQQS

SEQ ID NO: 6081 - protein, 41 aa, synthetic construct
RYRLLQRMWRFYCNKKLAMMLLWYARLSLRNGLKLRWRATF

SEQ ID NO: 6082 - protein, 51 aa, synthetic construct
FLRWMQKLLKLFRTKFRAWCYREKWLQKRHALCCAKFAKVKAHKAGFAALI

SEQ ID NO: 6083 - protein, 56 aa, synthetic construct
RLRMFRKLIRKLRKFRVTYRPIDATAAKLERIWWLKAQKWLRTPLKERPQLKWILV

SEQ ID NO: 6084 - protein, 63 aa, synthetic construct
KWRLMCKLWKWLKKKDARYAMLAQGEERLCDQPFTAYKKLRPRMKKPKLRLLFAARHTQGAAR

SEQ ID NO: 6085 - protein, 20 aa, synthetic construct
LLRFLSRLYKFIKRRELRVF

SEQ ID NO: 6086 - protein, 46 aa, synthetic construct
FIRMFNRILRKMKKRKLVLTKPHGSNFLWARLRYTALLRRKACGKA

SEQ ID NO: 6087 - protein, 60 aa, synthetic construct
RLKFLRRLLRRIQKYELANEKMYSKWLAKKAAYATNAMKPALRAQMKLWNPWTKRMKHKL

SEQ ID NO: 6088 - protein, 49 aa, synthetic construct
KFRWITRLMKYFKKGWDKAQVRYALARRLYARPAKAAPICLFTNLFKKR

SEQ ID NO: 6089 - protein, 31 aa, synthetic construct
KLKYMKKLFKYLRRLDRMLNAKGMGRQLLLA

SEQ ID NO: 6090 - protein, 37 aa, synthetic construct
WLKYLKKLLKRMKKRRRRKLPAQWTARANFAEEVNLY

SEQ ID NO: 6091 - protein, 32 aa, synthetic construct
LFKLLRKYWKWFRCNCWNCRALTRAKARCCLA

SEQ ID NO: 6092 - protein, 47 aa, synthetic construct
LYRWLTRLFRRFPRDLPAKLRRCYHVKRSKAAATLPRDGKWLATRCT

SEQ ID NO: 6093 - protein, 20 aa, synthetic construct
LLKFLCRLIRFWNPWRKAGK

SEQ ID NO: 6094 - protein, 43 aa, synthetic construct
RLKLLCKLLKRFHCILASASPLRRLHKRKTNAHDRKGKERLRN

SEQ ID NO: 6095 - protein, 23 aa, synthetic construct
RFKFWNRLFRIMQKRAMRANAAL

SEQ ID NO: 6096 - protein, 59 aa, synthetic construct
FLKLMHRFLKLLRRKLFLRRRSSILQIEWLRWEHHIFERRKGKARQALCLKNLRCKAAL

SEQ ID NO: 6097 - protein, 74 aa, synthetic construct
RFRLLCRWYRRLKHHLIIKRLQKLLKDLLRLLNRLLGKVRHCIFRKRWNGLEWMKQAAKTAGMTNALSELFLIL

SEQ ID NO: 6098 - protein, 87 aa, synthetic construct
KFRYIQKLIRLIKRLQPLPMLRKALNVALQCRNAERRQKPNKAILDRMALKAAPRRKKAERCEHTAKLQVEAEKLRKKRLALYGTRG

SEQ ID NO: 6099 - protein, 51 aa, synthetic construct
RMRIFKKIMRKFRTRHAQKKALHHKRRAPADLAGRLLAFELADILACRYQM

SEQ ID NO: 6100 - protein, 40 aa, synthetic construct
FLRYMQKIIRYFHKVKRSTRLYAALRIKLLRIKPKASKSA

SEQ ID NO: 6101 - protein, 55 aa, synthetic construct
IYKILCRMFRKLKPAQDSLTLYAQIKLEIFWKAKTLCKLCRKKRPARRTQARLLR

SEQ ID NO: 6102 - protein, 23 aa, synthetic construct
KYKLLQRYLRLLNPAKGKITALK

SEQ ID NO: 6103 - protein, 43 aa, synthetic construct
KFKMLRRFLKKLKKVGKRHRHARVILQLSNVARLSDVKLACYI

SEQ ID NO: 6104 - protein, 28 aa, synthetic construct
RLKFWCKFFKYWKQLHSLKILALAKAHR

SEQ ID NO: 6105 - protein, 39 aa, synthetic construct
IFRWLRRYLKYFKKERHFLKLKALAAALMCCCCSYKLRH

SEQ ID NO: 6106 - protein, 22 aa, synthetic construct
ILRFYPKLLKKLHHMAMRRVAA

SEQ ID NO: 6107 - protein, 25 aa, synthetic construct
MLRLFSKFLRRFPKLPKALQGFKKA

SEQ ID NO: 6108 - protein, 96 aa, synthetic construct
KLKLFHRIFRLWRPYDLAKSPKAPAAGVARPSKSLRQKCPQLKTFPDALRRALWVFELYHRRALLRHCRKRRKPAQRLRTYAAAWKTFKPRHAWRR

SEQ ID NO: 6109 - protein, 55 aa, synthetic construct
YLKYFRRLWRRIRPNIARPKAIADPKMKRRALKLLRPMMKLLLHWLIYAMKAARR

SEQ ID NO: 6110 - protein, 36 aa, synthetic construct
FLRFWNRLLKKFKTFFEWRKALQFADACRKFKLRAV

SEQ ID NO: 6111 - protein, 69 aa, synthetic construct
KLKLFCRLMRKLCRPDKTATLGDFIRQRNLRLKLVQKACKCRKAASLLANFFWQAHLMRYAIKCARNRH

SEQ ID NO: 6112 - protein, 20 aa, synthetic construct
LMKWLRKIMKRFKCLYAAAQ

SEQ ID NO: 6113 - protein, 28 aa, synthetic construct
LLRYFRKYYKRLKSSIAAYPARVASKYK

SEQ ID NO: 6114 - protein, 39 aa, synthetic construct
RLKLMRKIMKKIRCWGTACVLKYKRLLKAKLLKTHNTLA

SEQ ID NO: 6115 - protein, 28 aa, synthetic construct
YFRLFRRLFKFFKRRAPLLKNSLYLVAL

SEQ ID NO: 6116 - protein, 49 aa, synthetic construct
RWKLMSRLFRKLRHPACDDALGFLLTDKLMKSLKFKLRCRMYCSARWAL

SEQ ID NO: 6117 - protein, 42 aa, synthetic construct
KYKFLKKLIKKYKKMAHGPRAYTLYRLLFLCRKEDALLQDLD

SEQ ID NO: 6118 - protein, 34 aa, synthetic construct
LIKMFKRILRRMSCRRKDNLIWRELLLGCAKLLR

SEQ ID NO: 6119 - protein, 30 aa, synthetic construct
LYKLYNRFLKRWRKCRESKLHTAKAAGQKN

SEQ ID NO: 6120 - protein, 44 aa, synthetic construct
RFKLLKKFLRKLKNLAGNLKTNSWARPRKWDLKAFAVIAKLNGV

SEQ ID NO: 6121 - protein, 36 aa, synthetic construct
RLRWWKRWLRLFRCLKRKCLVRRFNGFILLILHALY

SEQ ID NO: 6122 - protein, 64 aa, synthetic construct
LWRLLHKWFRMFKRKWLDCHRMAKLFARPRNFLLMARKMANKEHGAMLKFELLAAHALKAMHLH

SEQ ID NO: 6123 - protein, 28 aa, synthetic construct
MLKLYRKIMRLFHHHYLGLAKGRRLLCL

SEQ ID NO: 6124 - protein, 28 aa, synthetic construct
RIRLLRRFYRLLSRCRTLTMYRLCHLRN

SEQ ID NO: 6125 - protein, 29 aa, synthetic construct
KWRILRKMLRFFNQKAEKGRVALKAHNCA

SEQ ID NO: 6126 - protein, 22 aa, synthetic construct
YFRLLKRLWKRWPKLMALDKMM

SEQ ID NO: 6127 - protein, 66 aa, synthetic construct
KLRLLRKIIRKFQRAMGCIDVAALGKHAFYPNLNRKLAALRYKRPRELKVKNKNKRLYALKRSCNA

SEQ ID NO: 6128 - protein, 77 aa, synthetic construct
LLKLLRKLFKRFKNLARLKLRLRAAKSCEYLAFVQEKRLVPCAPQWFLVKLGRNAIKQFRGGWYRKLLKIKIVICHL

SEQ ID NO: 6129 - protein, 29 aa, synthetic construct
RLRWLPKFMRMLKTSKKDLRLATKLLQNS

SEQ ID NO: 6130 - protein, 22 aa, synthetic construct
RFRFLKKILKRIKPLDAKAALE

SEQ ID NO: 6131 - protein, 23 aa, synthetic construct
RFKMLHKLLRRLKRMAFYVCAKG

SEQ ID NO: 6132 - protein, 42 aa, synthetic construct
RIRFYRRLFRWLRSAKLRLKRVGAAFLWLLLTKDLKNDKKTS

SEQ ID NO: 6133 - protein, 52 aa, synthetic construct
KWRFLQRLLRRLNKLMKWKCLLCRWPKMLLHGSLASFKQAKRMDMKLKHPLA

SEQ ID NO: 6134 - protein, 68 aa, synthetic construct
KLRFWQKLLKRWKPTAAYRKMRVCSQRALARGKFWSTKFCRCWAGAALVRMRDRQRRLRHALATRAEG

SEQ ID NO: 6135 - protein, 82 aa, synthetic construct
RLKLFNKYLKWIRCDAAKWIAAMAPVYHFCAEKQFKCKALRTTCKLFRLARAHLKKPLLRHRRCSLRQERTKKHAARLFKCR

SEQ ID NO: 6136 - protein, 96 aa, synthetic construct
KYKWYSRLFRRFKNGGRRKCRLKRLLSKPCKKALRAAMPQSKFKPNKALALRYANAWGSRDRKLRFNKAGASYAARLLIAARSRCALKGRGAAHKH

SEQ ID NO: 6137 - protein, 22 aa, synthetic construct
LLRMLKKLLRKIKQLLRKLDGY

SEQ ID NO: 6138 - protein, 24 aa, synthetic construct
ILKFFRRLLKRFCRASLYWCKHRA

SEQ ID NO: 6139 - protein, 47 aa, synthetic construct
KMKMIRRWLKLWRKKRPYRADFILAEAQTKTAHLDLRRAFQLRAVLK

SEQ ID NO: 6140 - protein, 52 aa, synthetic construct
RYRLFRKWIRRFKHWKLFEQKHARRGDADNLARAAAARNLLDYRLMAGHEKK

SEQ ID NO: 6141 - protein, 25 aa, synthetic construct
YLKFIRRLLRMFNRSLRMEMRHAKA

SEQ ID NO: 6142 - protein, 50 aa, synthetic construct
KLKFITRLIKKLRRHKTALVGGNARAAKHSDALRSKQQAAECILRKKAKY

SEQ ID NO: 6143 - protein, 99 aa, synthetic construct
RFKLFRKWFKYYNRAPIRNLCAGHIRGSYYLPYWCRLAASAFLMQRISAKASRKAKWLLARAIKCKALKSLILKRLLATIATKRALLPFADTNKLNFAK

SEQ ID NO: 6144 - protein, 28 aa, synthetic construct
WYRWWKRLLKLWKKRLFTKHAAAKRILA

SEQ ID NO: 6145 - protein, 51 aa, synthetic construct
KLRLIRKFLKRMQTLRYAIWRLGRAWRNLPAFRANRAVRRARGYMCFWKVR

SEQ ID NO: 6146 - protein, 35 aa, synthetic construct
WYRYIKKYIRKFKRKPLLGLERLILKLALLYNLLT

SEQ ID NO: 6147 - protein, 63 aa, synthetic construct
RLKLLKRLMKKIKHKLYVLKVAQGLHTRLKRVFAHLYLELMCLKLTPRWEIILRLFKKHYERL

SEQ ID NO: 6148 - protein, 42 aa, synthetic construct
RLRWLQRFYRKWRRHIPAVKALMAGLQKSARLRWAAPPHIAL

SEQ ID NO: 6149 - protein, 68 aa, synthetic construct
KMRWLSKMLRRLKRKLPYGNFVRPKKLECRSTARPKSKLALFLPYRLLQDQCSCHKAIANALAKKALL

SEQ ID NO: 6150 - protein, 20 aa, synthetic construct
RLRLINRLLRMLHRVFYQRH

SEQ ID NO: 6151 - protein, 81 aa, synthetic construct
RLKLLKRLYRFFPRAKLQIRFGSLELKASVKFAEPIRLRLKDKPARKRVQRLYRLAKARATAPDKILDFKLVAIKYVKQCL

SEQ ID NO: 6152 - protein, 84 aa, synthetic construct
LIKYLRKFWRLMRRRHFATYPHAAKLHASLILYKKDYKACKACNGHQVARQKAAVLLLRGRKLRGLAVLCRAKFSARRNEGNRL

SEQ ID NO: 6153 - protein, 54 aa, synthetic construct
WLRFLTRLIRKWKQKSPKNYLRAAPRLPELKRCQPPANPFLALNKARPVKPKAA

SEQ ID NO: 6154 - protein, 98 aa, synthetic construct
FFKIFRRFFRMLKCQHMKALLRGQRNLLQDLENIIKARKPLTKVRAALAKKQRRMAHKHLIAVRCVHKLIRVTRALVKYCKACRQLRKGLLALKSSIK

SEQ ID NO: 6155 - protein, 70 aa, synthetic construct
RWKFLKKWFRKMNCRAEMRLCCAWRLKHAKFAGKAARMARLLRAIKAKRLRKAMQEKITFCQWADKASLI

SEQ ID NO: 6156 - protein, 57 aa, synthetic construct
KMRFFKKLIKKFKQLAAAVSSKWRRSIALLLVSIKFKHEQAILRKVRRAFLKANIQL

SEQ ID NO: 6157 - protein, 43 aa, synthetic construct
KLRYYKRFLRKLPRMDDAPKRAAPATGFPFKCLRSMKRLTAEA

SEQ ID NO: 6158 - protein, 30 aa, synthetic construct
FFKMLQRMFRKLRTERLDAAAAYCSLKSKA

SEQ ID NO: 6159 - protein, 75 aa, synthetic construct
KLKLIHRLWKWIRKLQVWTLKAAADLKKIMVRAGLKKMRAHLKAKFPQKECMAAKSDHKYLYRRQESLNRKDVRR

SEQ ID NO: 6160 - protein, 56 aa, synthetic construct
MLKLYKRMYKLMHRKAELSPIRACTLLKNEIRAQRGKRHRLKSAGKRAMDAWNARK

SEQ ID NO: 6161 - protein, 22 aa, synthetic construct
LIKFFNKWLKRFSKALARLNAV

SEQ ID NO: 6162 - protein, 24 aa, synthetic construct
RFRYFNRLFRKMPRLLLLNPAKRL

SEQ ID NO: 6163 - protein, 50 aa, synthetic construct
KWRLFQKLMRRYKKERQAEICGLVLAKFARPAAYAKALRKDLHEWKQACA

SEQ ID NO: 6164 - protein, 81 aa, synthetic construct
KLKLFTRLYRKFKNLILGLEACLMLMAFRLLLLKAYKPASAKVLFEKSRRHLKLNTWNLKLPLASRYEDDCKKMPRKMKCK

SEQ ID NO: 6165 - protein, 20 aa, synthetic construct
KFRILCRYLRFFKQKLALRA

SEQ ID NO: 6166 - protein, 76 aa, synthetic construct
LFKFIKKYWKLYTSVKRKIYRLARLRAYKRLALICARALKSAKRAEKTWDLTLCVFAYAESLKKAEDAQLIVEWPK

SEQ ID NO: 6167 - protein, 33 aa, synthetic construct
KMKWLRRFLKRFCTKAKTLAKSFPLDRARLNLA

SEQ ID NO: 6168 - protein, 36 aa, synthetic construct
LMRWFRRIFKYYRKARQALAALMRRLLTNEKMKRAC

SEQ ID NO: 6169 - protein, 42 aa, synthetic construct
KFRYFPRMLKRLQRRHPQLLKAALCRPLMQHAKAYKKQPAFL

SEQ ID NO: 6170 - protein, 58 aa, synthetic construct
IYRMIKRLFRRLHQERKASKLHTRLRSKAIAKRKKPQWERALLRRTAMYAAMPNYALK

SEQ ID NO: 6171 - protein, 46 aa, synthetic construct
KLKLFSRLYKLLPCLAYMWLQRDKKKRLVWSFVRKKKLLWIRLKLR

SEQ ID NO: 6172 - protein, 40 aa, synthetic construct
LLRWLQRLLKRLKKIRLKNPRELKKKIRMKFRLLCSLCVQ

SEQ ID NO: 6173 - protein, 75 aa, synthetic construct
LIRFWCRIWRLIRTGRHYARELRRNLEAASLMNKAMWWKRRDAAGHKLKAPATSLKWARIACKMAKAKRKTLIAL

SEQ ID NO: 6174 - protein, 78 aa, synthetic construct
LLKILRRLFKFYKKQWLWGRLDKRRFAAKQDMKCLCRRAQVWIWADFNAKARHQKLKILALKRKCAPDRKAGMSDKGA

SEQ ID NO: 6175 - protein, 94 aa, synthetic construct
KLKLLRKLFRMLRQNRRLFLKLSCKSDPRNLRLRKTKALKHWWFALEESELVGPAPRKDTQRLKKLIALKWQKFRAFASPNALRYKTARDHQSG

SEQ ID NO: 6176 - protein, 35 aa, synthetic construct
RLRFMKKYLKLWRKRICLGRARLARMAKAPLSAHR

SEQ ID NO: 6177 - protein, 68 aa, synthetic construct
KLRLLKKLYRRWPKCRRRAFRNGVLKLPPTRLKECAKLVQIRAHSLLLWAQANSHLRKACRWSEAAFL

SEQ ID NO: 6178 - protein, 37 aa, synthetic construct
LIKLFRKMLRRLKKHNKKRSYKHLNTYQFQLAAKMCA

SEQ ID NO: 6179 - protein, 67 aa, synthetic construct
MLRYYRRFLRKLRNEKKSLALQRNKKYWRGVRAANVAARLLKSCLRPRRHTATACRCSVRCRLTALT

SEQ ID NO: 6180 - protein, 55 aa, synthetic construct
LMRLWRKMIKLMRRGNNRKHQKAAFALLHILAFADIKGRAEKKTALRVKRQFWPL

SEQ ID NO: 6181 - protein, 43 aa, synthetic construct
IIRWYKKLFKRLKCAAQGKKCLKKLANMNGKTDMRLLWLKGKD

SEQ ID NO: 6182 - protein, 48 aa, synthetic construct
LLKLLKRYLRRINRDRLEQSLALGLVVAGRRDAACRLNMNRRCFGYKI

SEQ ID NO: 6183 - protein, 56 aa, synthetic construct
YIKFLRKWLKKLKRSWAKRIVRHIRAQERLVFCKLPKELVALKNASEGALKRLLCC

SEQ ID NO: 6184 - protein, 53 aa, synthetic construct
RWRILRRWFKFFRSVGLAFGRAAKLAHRPDLHAKATIFRGLQACALKAMARAA

SEQ ID NO: 6185 - protein, 40 aa, synthetic construct
YMRLYKKLLKIYKRLSHKKSYRIKAAWDLLYVKYLIKEAV

SEQ ID NO: 6186 - protein, 28 aa, synthetic construct
LLKLMKKLYRRYRCGEKLLARFIMSLKL

SEQ ID NO: 6187 - protein, 41 aa, synthetic construct
KWKLWKKMWRLLKKEAANRRRALKKSNLKAPILEKPSAKHM

SEQ ID NO: 6188 - protein, 50 aa, synthetic construct
RIRIWKRWYKILCRREKVFWSSAKTIMLLRAKRITLRLLCWAAKALKQAK

SEQ ID NO: 6189 - protein, 34 aa, synthetic construct
LFKLIHRFLKKLNHAKWHKHRPTANKVLKLECLR

SEQ ID NO: 6190 - protein, 34 aa, synthetic construct
LIKMYRRFLRKMKNLQRAMYAGSWACAAFAWARK

SEQ ID NO: 6191 - protein, 21 aa, synthetic construct
KFRLFSKLLRIWNNAAKKSTK

SEQ ID NO: 6192 - protein, 34 aa, synthetic construct
FMRMIRKLMKLLRSVRKYQRLAYLLYQRTHVALL

SEQ ID NO: 6193 - protein, 45 aa, synthetic construct
LMRLYPKLFKFIRRRDAKLVRALLFNRLVKFMLARVDDRFHRSGR

SEQ ID NO: 6194 - protein, 82 aa, synthetic construct
KLRFFRRLMKMLKRRPKHARDLKLFLRLREAGYTAKRLFRRLKERKWKDWAILTLERALYVKQYSRGLASLTQADGLVWATT

SEQ ID NO: 6195 - protein, 52 aa, synthetic construct
KIRLMKRLFRKLRCYDLAKTQAERPLRWHARKRMKIYFAKTKAISAIMAACT

SEQ ID NO: 6196 - protein, 83 aa, synthetic construct
KYRILTKLWRLLPRKRKRKNRCASANNFACGRLLNRHKFNHMQKSADPAIWALLARRRLWLLQKCVHYKVKRRFEVADKAAGA

SEQ ID NO: 6197 - protein, 26 aa, synthetic construct
IFRFLRRLWRRIRTLRAADLAAVVQA

SEQ ID NO: 6198 - protein, 27 aa, synthetic construct
LMRLYRKFFRKLQNKMLKNAGQLAKKL

SEQ ID NO: 6199 - protein, 36 aa, synthetic construct
LFRLFKRYFKKLKRGAVYERRSLHRMAQLARIMAAI

SEQ ID NO: 6200 - protein, 51 aa, synthetic construct
KLKLFHRMLRLYRRKMNAQGFAKKMRAKAIFGYRPDLALWNLCKAKALVKI

SEQ ID NO: 6201 - protein, 24 aa, synthetic construct
LMRLLKRLLRKYRRNDKLAKQLIH

SEQ ID NO: 6202 - protein, 52 aa, synthetic construct
RFKLFRRYLRYMNKVWKPQHEALLIKRQAMKQAADWFARALAQKCLLPARPR

SEQ ID NO: 6203 - protein, 45 aa, synthetic construct
YYRLMPKLWRYLTRLYAAHFWPLKIVKGRTTVLARRRLLNWRKLR

SEQ ID NO: 6204 - protein, 28 aa, synthetic construct
RLKLYHRLLKFYRKQRHHRLEAIIGPAA

SEQ ID NO: 6205 - protein, 51 aa, synthetic construct
WLRIFPKLIKYWKRDKTAHKFKIFCGLALEALARKLHLDRKATHQDLAKLL

SEQ ID NO: 6206 - protein, 77 aa, synthetic construct
RLKFMKRLLKFYCQYKAQRRFCAMAPIARLKDLSKLKEKYYACPLKENRYAMRLSDRVAAVRWRANAANRASAGRLP

SEQ ID NO: 6207 - protein, 76 aa, synthetic construct
RIKFWRKYYKLIRKALHFWYCTCWAKDRLVKAKALKWKLKILAERPRARLCAPQRKARDCHMLAEVSRARALMNVE

SEQ ID NO: 6208 - protein, 38 aa, synthetic construct
RLKFLRRFFRLLCSVRRDLLHRNAVAVKWDRLHHKSKI

SEQ ID NO: 6209 - protein, 23 aa, synthetic construct
FLKLMSRLLKRMKQKTNLKKKAL

SEQ ID NO: 6210 - protein, 57 aa, synthetic construct
KFRLLKKLLRKLKPKRCIKDSYAEDLQTAARAYHVQMIKHYWLKAKKKADAMYLYLF

SEQ ID NO: 6211 - protein, 30 aa, synthetic construct
FLRYIQKIYRKLSKAKACAVLNRKKLRMLQ

SEQ ID NO: 6212 - protein, 53 aa, synthetic construct
KWRYFKRLLKRWSSLRLLRIGTRLHARRSLLRRKYWSHMAAEGMMKFVALNAK

SEQ ID NO: 6213 - protein, 32 aa, synthetic construct
KLKIFHKYFRYWHTHKKVLCLLKKRVLAAHAK

SEQ ID NO: 6214 - protein, 38 aa, synthetic construct
FFRLLKKYLRKISKACYRCGQQHAMAARAFALKLDTRI

SEQ ID NO: 6215 - protein, 51 aa, synthetic construct
RLKYFKKFLRKIRKYKWKRNELERIIRCCRAPAILIRKLKYLLSHILMNLL

SEQ ID NO: 6216 - protein, 45 aa, synthetic construct
FLRLLRRFFKRIHSLRSRKKAKLYNLRLAKKRGCFPIFTQAQAAL

SEQ ID NO: 6217 - protein, 44 aa, synthetic construct
LFKYLRKLMKKLPKMAARTDLRGKNKKRAAAKLKMDCRLCDHFP

SEQ ID NO: 6218 - protein, 64 aa, synthetic construct
MFKFYKRFLRKYRTQECAHWLAKIKYAAARYAHKMKASRGMALILLMKRCRTPKRRLRLIMLLL

SEQ ID NO: 6219 - protein, 25 aa, synthetic construct
LFRLLRRLLRKFSTALWKEIARAKP

SEQ ID NO: 6220 - protein, 41 aa, synthetic construct
RLRLFRKWYRRFRKKLKHTVAKLGACNCLQYLKKPALAAEM

SEQ ID NO: 6221 - protein, 58 aa, synthetic construct
KMKIYRRFFKRLHRANPGKLEMANAACVSAWRKSGLCALAGRLKKPAERDALKRKTEG

SEQ ID NO: 6222 - protein, 85 aa, synthetic construct
RMRLFKKWFRRYNRFLRAEAKWRGYLNYKQKLPAAWCKRDLLFWLALYLPKQPKRLCGHQAPRRFLADKLAIWLMKRRLAAYYYP

SEQ ID NO: 6223 - protein, 40 aa, synthetic construct
FYKFLRKLLRRWKRAARSKLNKLSFPRVWFLLARAARKLC

SEQ ID NO: 6224 - protein, 33 aa, synthetic construct
RLRLIHKLYRLFRRWKRVRLLCAKALNEKRKLD

SEQ ID NO: 6225 - protein, 33 aa, synthetic construct
RLRLFSKLLKLLQKFLERLRWLKRKALAHLHVN

SEQ ID NO: 6226 - protein, 21 aa, synthetic construct
WLRLLKRIFRFWKRYTARQML

SEQ ID NO: 6227 - protein, 87 aa, synthetic construct
KYRLLKKLYKRLKNMLCKKRMGGRSKVRFWTYMLAYHAAHARLKIGKRRLLIAKLQYDRVLFRLWQMTKKKSLAGIGVAFKAALVLA

SEQ ID NO: 6228 - protein, 79 aa, synthetic construct
KLKLWCKYLRIMKNRARLELGELYAAKASKLTHFHLFILRMPMNNRRCKLKKDRRIGNGGQVAARHVRAILKLKYALAL

SEQ ID NO: 6229 - protein, 99 aa, synthetic construct
MFRFLKKLLKKLQKWLAKNPRARVRRLLTELHIHVRKRLAVCWRIKGAWELRHKLTTLFHSCRWDLMKVLQKASAYDLKRLKAELCWRFLKSNRVRRSK

SEQ ID NO: 6230 - protein, 38 aa, synthetic construct
RLKYLPRLMKKMNKYKLGYADFRVFRLAKKCLLEGYKH

SEQ ID NO: 6231 - protein, 61 aa, synthetic construct
FFKLLKRWLKFLTSARPWRIAAWKRHKKIRYRRIALRQLAPKKKFLFNNNARSRFPWAAKV

SEQ ID NO: 6232 - protein, 24 aa, synthetic construct
WIRLMKRYMKKYPRRLYLATPAKL

SEQ ID NO: 6233 - protein, 58 aa, synthetic construct
KFKWLRKYIRRFHKIWFPRWAAFKLCRVWLTGAQRAKIRGFRLDRNNAHLKRRLLAAL

SEQ ID NO: 6234 - protein, 32 aa, synthetic construct
RLKMYNRWFKRLKSARANANAWAKALKACLVM

SEQ ID NO: 6235 - protein, 20 aa, synthetic construct
RLKLMRRLYRRLNSEPTLFL

SEQ ID NO: 6236 - protein, 20 aa, synthetic construct
LIRYYNRMFKLLSKAAPKVK

SEQ ID NO: 6237 - protein, 33 aa, synthetic construct
FFKWLRKWLKRMNQQAALLRKAKKLIEALRNLV

SEQ ID NO: 6238 - protein, 37 aa, synthetic construct
RMRLIHRMFRRLNQAAKLLLIARMARMMKELKLQVAL

SEQ ID NO: 6239 - protein, 71 aa, synthetic construct
KLKFYRRIIRRIQRFYECKLEFRDAELAHAVMLLAAAALLMLLREAKTKIRPKKESWQFAAWARKRPACRG

SEQ ID NO: 6240 - protein, 35 aa, synthetic construct
RFKILKRFLRKFPHHTAAQIEYCALKRRAAAPAVK

SEQ ID NO: 6241 - protein, 23 aa, synthetic construct
YFRWLRRLLRRLQQLRPVSLNAD

SEQ ID NO: 6242 - protein, 41 aa, synthetic construct
LFRFLKKLLRKIRHNKLAMAAMLLIRELSYFLRWLFQRELD

SEQ ID NO: 6243 - protein, 47 aa, synthetic construct
LWRLLRKLFRKLKRKMLTYQKGAWARYQCLPLLILYFTKKEVRAKTL

SEQ ID NO: 6244 - protein, 25 aa, synthetic construct
RLKWYRRIFKFWKPHLRPLKLLAWL

SEQ ID NO: 6245 - protein, 40 aa, synthetic construct
RLKWFKRWLRKYRRKVAIKAAEWRVKAARTMSLLAIRWDA

SEQ ID NO: 6246 - protein, 21 aa, synthetic construct
KLRFLTRILKWWRRLHLATQL

SEQ ID NO: 6247 - protein, 31 aa, synthetic construct
RIKLLRRLLRLYRRDKCDLKCTLMRRPLSSV

SEQ ID NO: 6248 - protein, 81 aa, synthetic construct
KMRIFRKLLRKFKKAIKCRGKFADVSNDASRNYFLILRLLKLIICLKYKDAKWDLKLKKVLRISALIREAWGLRDRLKKEC

SEQ ID NO: 6249 - protein, 51 aa, synthetic construct
RYKWMKRLLKRWKTKSKSLRAKKKLAPLALVLLAPEAIHLKARNVKLDAKR

SEQ ID NO: 6250 - protein, 92 aa, synthetic construct
LMRFYKKWLKKLKKANLDKLAKMKAKAAAKATKLKPVRRWLHWNDYESHSCCTLCKCLKKRHMLKAPPYACRPPLIAEAAARKTAAVEKQKQ

SEQ ID NO: 6251 - protein, 64 aa, synthetic construct
WLRFIRRLIKFFSRRTCKELYLRIAAANKCLALLLQMFRCKKLARIALKECKLIRPTRKRPRAK

SEQ ID NO: 6252 - protein, 52 aa, synthetic construct
FYKFLKKFMRFIKKRKANLMRRLMRLYKLAPMRVWVARYADKTLRELTGGLA

SEQ ID NO: 6253 - protein, 86 aa, synthetic construct
LIRLLSRYWKRIKRAVGRDGVMKLRYAKKAVMSKRLTAYYNVMYAAPVKKARKAKRIARMKCKVALRKALIRLMATKPAINAERTR

SEQ ID NO: 6254 - protein, 24 aa, synthetic construct
RLKFLRKLWRWWRTHADCAYRLAE

SEQ ID NO: 6255 - protein, 47 aa, synthetic construct
RYRLLHKWYRRLCKHKQLLARVPEMAPLKRIAPALQWLHKKKARAHL

SEQ ID NO: 6256 - protein, 29 aa, synthetic construct
RLKLFRKWYRRLKSTYRVGRLAAVDVADV

SEQ ID NO: 6257 - protein, 43 aa, synthetic construct
LLRYYKRFIRRLRQRMEQRPAIAVLKKMERWDLAAFLPKELLA

SEQ ID NO: 6258 - protein, 57 aa, synthetic construct
KLRFIRKYLRLFRKRLRRLAKKAAKTDLYNKAAQSRKVSVLCRPDMLRLKSMDTECD

SEQ ID NO: 6259 - protein, 22 aa, synthetic construct
FLKLLRRWWKKIQCLLARRHFM

SEQ ID NO: 6260 - protein, 21 aa, synthetic construct
FLKMFRRLIRKIRNKDTACAA

SEQ ID NO: 6261 - protein, 39 aa, synthetic construct
YLKYWKRLWRIIRKLLQTLPALRKTANKHKAWLAQRSKC

SEQ ID NO: 6262 - protein, 49 aa, synthetic construct
KFKYLPKYLRRLQKECKFRKPWRNWARKFLLWYALMVRLRRLATINLMT

SEQ ID NO: 6263 - protein, 45 aa, synthetic construct
YLKFMKKLLKRLQSKHMANYRAAKAKMAIKRALAFFADVKLMAIK

SEQ ID NO: 6264 - protein, 43 aa, synthetic construct
RWKFFRKFLKLLKRTREGHTKADAQATKSLAKLERSKIWRCAQ

SEQ ID NO: 6265 - protein, 40 aa, synthetic construct
RIKLLRRFLRLLKRIKRATTKCACRRCTLLSKCWVAVAKQ

SEQ ID NO: 6266 - protein, 48 aa, synthetic construct
LLKWWCKWFKRFRQRELHRFPLALHDRARKLAVLIGCRNGLLKPKLKE

SEQ ID NO: 6267 - protein, 25 aa, synthetic construct
RIKMLRRYLRKIQHPLATLWTRLKI

SEQ ID NO: 6268 - protein, 33 aa, synthetic construct
RFKMFKKFLRLLKKALAQLWLYPMLKWKRRKQY

SEQ ID NO: 6269 - protein, 63 aa, synthetic construct
ILRYFQRLLRRLNRLSRTAALLTKNVRPRPLDRMKRRAKATLLLRWKLRNIAMRLNVTWFTHV

SEQ ID NO: 6270 - protein, 21 aa, synthetic construct
MFKLIHKLFKLIKKHAKAKEA

SEQ ID NO: 6271 - protein, 45 aa, synthetic construct
LLKLLCRYLKLLKHKVRGVDNPKDRLNKAASAMKLPWRKKLILVL

SEQ ID NO: 6272 - protein, 39 aa, synthetic construct
LIRIIPRMLKKFNRLAAPRHRAANKARDLLHLPRHYLSK

SEQ ID NO: 6273 - protein, 89 aa, synthetic construct
RFKLWRKLFKKMNRLKERRYPLYFRLVKLAAKAAALVKILGAKAHEDPLRRRLLKDCPLSFPGHKPACKAKICNEARKVRGMAFYWQRD

SEQ ID NO: 6274 - protein, 65 aa, synthetic construct
WLKLLRKWWRRLKPEAAKWTGWKFLKKKAALAHVRCKRHCKLRPPDLAANGVQPRAAWMLMLCVT

SEQ ID NO: 6275 - protein, 79 aa, synthetic construct
RLKIWKRFWRRLHHQNAKETEEYKETRHLIMRRLGLKRLLIKMRLDAAALEALRPKIFPAKPKRLRMLRLRTALNAAVL

SEQ ID NO: 6276 - protein, 46 aa, synthetic construct
MIRYMPKFYKFLHPRRIKLADAKPATLARRERRKLAACHRRWSLSA

SEQ ID NO: 6277 - protein, 51 aa, synthetic construct
KLRIFKRILKKLRRRAFRRRGRASVLLCHKADIPSCGADRLALAMREWKRH

SEQ ID NO: 6278 - protein, 41 aa, synthetic construct
MLKWLKKFFKRFKRWQAATRARSYRHRTKAFRLYHCAAATR

SEQ ID NO: 6279 - protein, 35 aa, synthetic construct
FFKLIKKFLRRLKRPALFRYKAKMMHAAWLKRLVH

SEQ ID NO: 6280 - protein, 39 aa, synthetic construct
RWRLLRRMFKKIKRRKLWQLHILNGLSKLRAYLERHFAA

SEQ ID NO: 6281 - protein, 21 aa, synthetic construct
LMKLLTKLIKRLSNKAKMRQR

SEQ ID NO: 6282 - protein, 85 aa, synthetic construct
WFRMFKKLMKFLCQRLNFRAKLAWYNLWKLFNSWKMRAHMKKKLADAFMWRATQPKATKARLRALANLKAKHYKHDATLPLREMA

SEQ ID NO: 6283 - protein, 29 aa, synthetic construct
KFRILKKMFKFMPPAWKAWRTSRRFLAAL

SEQ ID NO: 6284 - protein, 72 aa, synthetic construct
LWRLFRKIFKFLSRKFYRAAFGNHMYAKARTPLLLCRIIPLVLKARMASKNARKRPAPLLTKREKWRARVKI

SEQ ID NO: 6285 - protein, 22 aa, synthetic construct
RLKLIQRLLRFFKKLHRRLWYC

SEQ ID NO: 6286 - protein, 75 aa, synthetic construct
KYRLLKKIFRYLKKIRGAALCVGGAICCKKKVLDRFQASVGAAKALREAQSKRAYSCWLRALWLRLLRYKMWRAL

SEQ ID NO: 6287 - protein, 57 aa, synthetic construct
LLKLLRRIFRKLSNNAHAKNVKLLQALPRTPMKRFLLAGKKVKYGMRRRALRIYPVS

SEQ ID NO: 6288 - protein, 21 aa, synthetic construct
LYKMLRRLYRLWNQGKKAYLD

SEQ ID NO: 6289 - protein, 28 aa, synthetic construct
FIKLMCKLFKKLKRRWLGAAGARWYKLR

SEQ ID NO: 6290 - protein, 37 aa, synthetic construct
IWRLYRRFFRWLTRASKLVVKARKKRAACVAHWAMMR

SEQ ID NO: 6291 - protein, 60 aa, synthetic construct
MYRLLQRFMRLLRKGGHLAQASKYRGAKWRPKMHLIAHALRIFYKAKASYLLRRFDAKWA

SEQ ID NO: 6292 - protein, 37 aa, synthetic construct
RMKYLKKFWKWYRRAACQAKPAAYNDALRGRYKRADG

SEQ ID NO: 6293 - protein, 34 aa, synthetic construct
MLRLFHRFFKYLKPARETRSCKLRLSYRKRLTLY

SEQ ID NO: 6294 - protein, 79 aa, synthetic construct
MLRFLRKLLRYLKTRHSIALRRDALGTHLHLIALAARKPHAAKRKETSADSIAKVLQMKLRLAARAKQVAYKVLPRWSG

SEQ ID NO: 6295 - protein, 34 aa, synthetic construct
RLRLLNRYFKLLKTRHIRAACAGRTRLANWRMFR

SEQ ID NO: 6296 - protein, 56 aa, synthetic construct
KWKFLKRYIKKMNRAKSHKAGNMHLKRRSIRANQETAAFLLGRAKLNFAIPKLMAA

SEQ ID NO: 6297 - protein, 20 aa, synthetic construct
RLRLFQRMLRLYSKAKIVYR

SEQ ID NO: 6298 - protein, 27 aa, synthetic construct
KLRYLKRWLRIIRQRAQRLRHAFARAS

SEQ ID NO: 6299 - protein, 28 aa, synthetic construct
KLKIYKKFFRILRKAMADSALARAKTKE

SEQ ID NO: 6300 - protein, 25 aa, synthetic construct
LFRMLRRLMRRWRPRAWEEKGQLAP

SEQ ID NO: 6301 - protein, 21 aa, synthetic construct
LIKYLKRIYKFFNKAHRIAKL

SEQ ID NO: 6302 - protein, 77 aa, synthetic construct
YLKLWPRLIKYLRHSAEAKHTWWHKEKRQKIFQRKWLRHCRKCAKLKRMTVKAYRTLAKDQKFIALRQRPACALRAL

SEQ ID NO: 6303 - protein, 21 aa, synthetic construct
LLKFLRRLYKMYKRPWLREDL

SEQ ID NO: 6304 - protein, 80 aa, synthetic construct
KLRMYKRWLKRLPRLYLYVLARPAKNLMLRTMRDQDPMALCLEATWRFACTCRVEPKGLRARLKLEHRAHEAKAAQGKKD

SEQ ID NO: 6305 - protein, 71 aa, synthetic construct
RIRLYRRLMRLLRPLRRCARATTRKAMQAKEFWKDRDRTARVCIRRRGQPKDKAAKAALYKDRYMNLAAPL

SEQ ID NO: 6306 - protein, 77 aa, synthetic construct
LMKLLKKIFKLFKCAKLQLNAGFARGLFWAMNCYKLCLEQCCTRRFNLHTRLKSARAWRLSRAAKAIYLYRRRAARC

SEQ ID NO: 6307 - protein, 39 aa, synthetic construct
KLRYFTKLLKRLKCGAQNTAKYRLLIRKARQQPMQQLLT

SEQ ID NO: 6308 - protein, 34 aa, synthetic construct
FWKYLKKLLKFLSSLRRLPFKRYMAAKKRALRYK

SEQ ID NO: 6309 - protein, 27 aa, synthetic construct
IIKILCRIYKRLKRLEKRLGASALLRG

SEQ ID NO: 6310 - protein, 33 aa, synthetic construct
RFKLWRKLLRRMKSGLILRVAALVNRGLTAGCR

SEQ ID NO: 6311 - protein, 33 aa, synthetic construct
FMRLLRRWLRKLKRNAASQSKEPAAICAANRAT

SEQ ID NO: 6312 - protein, 29 aa, synthetic construct
WLRWLHRLLKRFNRVKAGLLIKRRCMKSL

SEQ ID NO: 6313 - protein, 29 aa, synthetic construct
RLKMIRRLIKWIRNCLLKARWLKAISSHN

SEQ ID NO: 6314 - protein, 56 aa, synthetic construct
RWKLFRKMFRIIKRWCPATAANHAWAPALRVRRALLKERAPFMMRIAERRAGAILA

SEQ ID NO: 6315 - protein, 36 aa, synthetic construct
LFKFLSKYMKRYCCGQKSYKARLAATRAKARIARVR

SEQ ID NO: 6316 - protein, 98 aa, synthetic construct
KWKLFHRLLKKLTQSATPKSKFCSYRKKISTTCQRLLAAGRLLRKWEDLRPPMKRALQKKSKCLKERFRFLLARDLCKKEKHLAIYIVPPALVALANA

SEQ ID NO: 6317 - protein, 46 aa, synthetic construct
KMKIMRKLWKRLHRVAKEPAKTALKALWTKPAAEFAQWRRVTRYRS

SEQ ID NO: 6318 - protein, 43 aa, synthetic construct
KLRLMRKFLKKFRSAAVLVLRKAKREPQNMATLGFMQRRYVLC

SEQ ID NO: 6319 - protein, 36 aa, synthetic construct
KIKLFSRFLRRWRRLMAAWAPHHMRKLAFKMTMLWK

SEQ ID NO: 6320 - protein, 47 aa, synthetic construct
FWKILRRMYKFLRRERKKRRQRAIAALAPIFKQVDAHNPLKKSLWLH

SEQ ID NO: 6321 - protein, 93 aa, synthetic construct
RWRYINKIMRWLRRTRKAYALPAWAAHRAENKKALSRLRAKICRLDFLRLRLRNKIFLKCTPAPELGKLRPLPKGCYKRAIAKLIRKRAKLRP

SEQ ID NO: 6322 - protein, 27 aa, synthetic construct
WLRWMKRLWRWLRTPRAIRRAWLAIFT

SEQ ID NO: 6323 - protein, 27 aa, synthetic construct
RMRLFNKLFRKIRTWNAVACVLKEKAL

SEQ ID NO: 6324 - protein, 21 aa, synthetic construct
LIRLLSKYLKRLRRAYFQLVA

SEQ ID NO: 6325 - protein, 63 aa, synthetic construct
KYRLWKKMFKRLRKKVMDLVKDLAQAHLLARKLAAYNAARHQACSRTKNPLLRKALMRALGYL

SEQ ID NO: 6326 - protein, 21 aa, synthetic construct
FYKLIKRLWRKLNKTRELLSL

SEQ ID NO: 6327 - protein, 77 aa, synthetic construct
WLRLLKRIMRKLQRKRVKLWHKLKNEKNRETRGWKVPWYRLGDMLNMQKRNRPKLLSAPALHKKRRRLAIMCAKALA

SEQ ID NO: 6328 - protein, 87 aa, synthetic construct
MWKLYQKILRFLKPRSSKWVAKKPMLKKACLDHLKRVSLFAPPKLRLRCLKVAKKPAQLKKRKMEKCCEKGKRANAGTVRNALHAYK

SEQ ID NO: 6329 - protein, 20 aa, synthetic construct
WLKMLKRMFKKMRPLRAMLC

SEQ ID NO: 6330 - protein, 37 aa, synthetic construct
KLRMLKRLWRRLCNRLLGNYSKNSYLADLLKREQRNA

SEQ ID NO: 6331 - protein, 37 aa, synthetic construct
LLKWFHRFLRILKKAKKAMFMKSLKRRAILAEVKRQY

SEQ ID NO: 6332 - protein, 60 aa, synthetic construct
KLKLIKRLFRKFKRSSECWPAGTRKAILRDARTKRRALRLETDLLLMAAQKKRWAFRALL

SEQ ID NO: 6333 - protein, 30 aa, synthetic construct
RIKLIPRLWKKYHQKALKNRATKFAARYEA

SEQ ID NO: 6334 - protein, 52 aa, synthetic construct
ILRFLSRLIRRYQNHAKARYNRWLPFGCRLAFAKLENLRRRILPFKWAARRD

SEQ ID NO: 6335 - protein, 27 aa, synthetic construct
IWRFYKRLLKFLHKKLQRKLLEYLAIY

SEQ ID NO: 6336 - protein, 40 aa, synthetic construct
KIKLLRKIFKLWRRAEAAWNLRKKYRNDLLLRCLGEQVVK

SEQ ID NO: 6337 - protein, 40 aa, synthetic construct
KWKFYKKLLKRWTKYAAQKHGHARGDKKWACIWARNAAIK

SEQ ID NO: 6338 - protein, 24 aa, synthetic construct
LWKLLRKFLRRFKKKMHIAGDAPA

SEQ ID NO: 6339 - protein, 37 aa, synthetic construct
MLKFLRRLLKKYKSDIQDKKIVYLAEVARALRKAHSL

SEQ ID NO: 6340 - protein, 77 aa, synthetic construct
LFKIFKRMLKKIKTALARDTAWRHAFRPAPLIRRTLWWYAKELRRKLALPVKARPMKMRAVTVKKQAIQRKKLHERE

SEQ ID NO: 6341 - protein, 51 aa, synthetic construct
LFRLLHRLLRLLKKPLLFHKKANKEVLLDMCAQRSRGQRALASDRHDVTKA

SEQ ID NO: 6342 - protein, 54 aa, synthetic construct
RMRLFRRLLKRLSNAKKALDRPLARKDRRMTRLVLYASAKRPLAASKLMLKATK

SEQ ID NO: 6343 - protein, 35 aa, synthetic construct
LLRWYKKLWRFFRRAKPLCMVILQLEDLALARKKK

SEQ ID NO: 6344 - protein, 50 aa, synthetic construct
RMRLFNKWLRKLTPLAMWMHILNAPFAFCFRKKRAPKADAKRCCKALLRW

SEQ ID NO: 6345 - protein, 65 aa, synthetic construct
KIRFMSRWLRKLHTASLQSCLATKLYKMRQRKLFELDAAAKKLCDMGARQKKTGALGDKKKLGLE

SEQ ID NO: 6346 - protein, 27 aa, synthetic construct
LLKLFNKFFRKMKQKKALWQARHPAWD

SEQ ID NO: 6347 - protein, 48 aa, synthetic construct
ILRWLQRYFRKLSRVAARKLEWNKLRAFKGILAVRLRAHYFRKKCMGA

SEQ ID NO: 6348 - protein, 34 aa, synthetic construct
KYRLMKKFIRKLQRHLACLYALRDWKACNKSDRL

SEQ ID NO: 6349 - protein, 76 aa, synthetic construct
KLKLLKRLLRLFNQHLRAAAGRATTNATLDALSALVTHLYTRDHAACLMAKKKEGKAIRAVSDRLKWHRYRDNVKF

SEQ ID NO: 6350 - protein, 31 aa, synthetic construct
FWKLWRKLYRLFKPRARRKLALARHATRCIF

SEQ ID NO: 6351 - protein, 39 aa, synthetic construct
FFKLMNKMFRFMRRHSKLLRPNKAHEGRIRLALKAWLKL

SEQ ID NO: 6352 - protein, 68 aa, synthetic construct
KLRWYKKLFRIWNCKKLRKPRPALLRVHQCHKSALPALDEACDLAKAGMRAHMLACKAFYRAKMKKMI

SEQ ID NO: 6353 - protein, 39 aa, synthetic construct
RFKLLSRFLRWLRRSYPESRYLAAKLKQQLAARRRVQQH

SEQ ID NO: 6354 - protein, 52 aa, synthetic construct
RMKYIRKLLRIINRCLIGLRLCLRKHKQMQWKALLRKRGLMARAGSGSANLL

SEQ ID NO: 6355 - protein, 47 aa, synthetic construct
KFRYWKKWFKKLRHLSRLRAKETTTWWAYALKKAAGPDADTAAIRLI

SEQ ID NO: 6356 - protein, 46 aa, synthetic construct
KFRFYNRIYRRYNKLVPPRTARLKKREATANNALRCWGRERLKAAL

SEQ ID NO: 6357 - protein, 28 aa, synthetic construct
LFKFMCKLLRKFQRAHALLMERILQRNR

SEQ ID NO: 6358 - protein, 26 aa, synthetic construct
LLRLFHRLYRYMKRILKKQYLNRYAK

SEQ ID NO: 6359 - protein, 24 aa, synthetic construct
LFKIYRKLLRLFNRLFKKTNLAKR

SEQ ID NO: 6360 - protein, 65 aa, synthetic construct
RWRILPKLYRLMKRKPRLTYQAARYRTEAALEKRNRNLPTLDRRAAARKKLFTARIGRLRAMPIK

SEQ ID NO: 6361 - protein, 41 aa, synthetic construct
RWRFLKKMFKKFKPLGRKCTKVALHSNARAVNLKIQHALAK

SEQ ID NO: 6362 - protein, 68 aa, synthetic construct
FYKWLSKLFRLLSRLGALKKAWNVRKAEPKRAGDVKNAKQAALDHLNQVQKACSELDVLLFFRLARKR

SEQ ID NO: 6363 - protein, 25 aa, synthetic construct
KYRFLRKWIRILQRAAAKIKLMELR

SEQ ID NO: 6364 - protein, 32 aa, synthetic construct
LFKFLSKFLKFFKPALRKKVERDEACAYRLAR

SEQ ID NO: 6365 - protein, 63 aa, synthetic construct
LWKLYKKMFRKIRKTSKRPPHALTANMARLRFRNTLILVAAKNAAVRGKEAKFHGARQRCALA

SEQ ID NO: 6366 - protein, 69 aa, synthetic construct
RLKYLKRMWKFLRRRFRTKKLDYDKPAEYYLLRRDATPLLPLRALSYEVRLKKAACTGNAPPPSRAAAK

SEQ ID NO: 6367 - protein, 74 aa, synthetic construct
FLRFYNRMLRKFTKGWPLGKWLRRKLYASARWRILYNAKKKALTKQLDNEVHAQCEPLAAKLLAAMALRAVFRA

SEQ ID NO: 6368 - protein, 46 aa, synthetic construct
FLKILKRLMKKMKRKKLQRAVVCVLREALLMLDLLRRPDNVLKRLS

SEQ ID NO: 6369 - protein, 40 aa, synthetic construct
KWKILKKYIRKLSQHMSRKLAVLTWRWKAAQLMAREKTAL

SEQ ID NO: 6370 - protein, 34 aa, synthetic construct
LMRFLHKFLKRLRNFCMLADGPHDKNHRKRLAKA

SEQ ID NO: 6371 - protein, 87 aa, synthetic construct
RYRLYCKWMRRMNKEKHRKTKISMATKCFVARDANKAAYCCLLKRAPPLPRRYVYQAKDLASRDLLQWNCAAHAKAKAKLLEKLKEK

SEQ ID NO: 6372 - protein, 29 aa, synthetic construct
KLKWLPRMWKYLRRTLEIRLALVLGWKKS

SEQ ID NO: 6373 - protein, 57 aa, synthetic construct
KLRLYPKIYRLFPRLLCRWGHWAKAAQMTAKFRKARKRSAHDRARYWSKKGALHLML

SEQ ID NO: 6374 - protein, 33 aa, synthetic construct
LLKFLRKFIKRLPKRLLMMLMRMRAKQSHKAHL

SEQ ID NO: 6375 - protein, 26 aa, synthetic construct
LWKLLHKILKRFRRLCIALRNKTAKQ

SEQ ID NO: 6376 - protein, 64 aa, synthetic construct
KIRLYRKILRFMKKWFLLLMALLRAYAATRAKFFPWPKFGMKWDKATRSARQRTEKLLKLVRKF

SEQ ID NO: 6377 - protein, 65 aa, synthetic construct
WFRLWTKLWKKFKCRFMQQALVGALMRAANKHIAMRLAMLGLGAEKAKRLAKKANIHTSRLRKRK

SEQ ID NO: 6378 - protein, 52 aa, synthetic construct
MMKFWNRLLRKLRSVRSLLASRAAFAAARKKERGAAIAARTGLLLLRKLNMK

SEQ ID NO: 6379 - protein, 21 aa, synthetic construct
KLKFLPRYMRLLPKDKAHVAI

SEQ ID NO: 6380 - protein, 21 aa, synthetic construct
MYKYMKRLFRKMQKERALFLA

SEQ ID NO: 6381 - protein, 28 aa, synthetic construct
KFKWLRRLFKKIKKLVCQLSARACASDP

SEQ ID NO: 6382 - protein, 55 aa, synthetic construct
MYRLYRRLLRFYRRNQFTMHRRALKVPSCARRPRRPAKAANMPAFVAAAVRRIKL

SEQ ID NO: 6383 - protein, 97 aa, synthetic construct
KLKLLQRLYKIFSTYVLVRWVVPAAKNQLEQAARLLLRYEKKTRKNWTQKRLPAKSARRRAVRHRVAAVYARGLADCAFLIEWKRYALRNLVALAEV

SEQ ID NO: 6384 - protein, 25 aa, synthetic construct
RLRIFKKLLKRLHPDRAKNLDAMTW

SEQ ID NO: 6385 - protein, 67 aa, synthetic construct
RLRFLTKLFKLWPNTACLGDMLFAADKRRKNDLKKLPKLCKWKAKKCKAQRVRPGYAFLLCSDCRRL

SEQ ID NO: 6386 - protein, 60 aa, synthetic construct
LFKFFKKFFKRWKTHLNNKKWIRAAMSDRRNGRKRKPHLFQLLALLVAIKPLARRKVAAK

SEQ ID NO: 6387 - protein, 25 aa, synthetic construct
IMRLWRKLLKKYCNGNYQRLLKAYK

SEQ ID NO: 6388 - protein, 45 aa, synthetic construct
LMKFIKRIFRRWKKLTAFLQWPRAKLMVIADLKGLNNARQRRNAL

SEQ ID NO: 6389 - protein, 28 aa, synthetic construct
WMKLLRRFLKKFRRRNGALMKAYYHLYY

SEQ ID NO: 6390 - protein, 67 aa, synthetic construct
KLRLIHKFLRRLRRLGKLAMMKPFAKAEDHAKQYELDKTKFDGAYYLRGKVLQRAEMARKNKLRARR

SEQ ID NO: 6391 - protein, 29 aa, synthetic construct
FWRLIRRLIRYMQKLPLAKARNKLRHNRA

SEQ ID NO: 6392 - protein, 49 aa, synthetic construct
FWKFFTKWYKMLHRARKVQCLRAKLKKRAADGLIGDFAGYLKVATARKL

SEQ ID NO: 6393 - protein, 40 aa, synthetic construct
RFKIFRKWLRYIKRAKAFALKVGRHHTAAAIVRAASRFFQ

SEQ ID NO: 6394 - protein, 50 aa, synthetic construct
LLRFMSRYYKRLCKLHCLSCKLAKACRKKVLRAREGLLRECLILWLKAPI

SEQ ID NO: 6395 - protein, 28 aa, synthetic construct
IMKLLKRLLRFLKCKNIAPYARFVWGRK

SEQ ID NO: 6396 - protein, 43 aa, synthetic construct
LLRLMRKLWKFWSRRQVRKPDKPAACTLAPKGMAAWLLAQAKM

SEQ ID NO: 6397 - protein, 40 aa, synthetic construct
LLKFLTRFLRRMNRYADIKMKYTAQMRLNWAMAKWGKRLR

SEQ ID NO: 6398 - protein, 79 aa, synthetic construct
LLRLFKKFMRMFSRRPCRPTKCLKAKKALLECAIKANWLQLLAKLQGECIASRRRNAAQTKRKPNYAWDAKVRKKLAKY

SEQ ID NO: 6399 - protein, 20 aa, synthetic construct
LLRLMKRWMRRMKSNAAKVM

SEQ ID NO: 6400 - protein, 55 aa, synthetic construct
KYKLLKKLWRKLKPAAKLPWALRGKLCCIKSRHKLKRLHLLAGCLPNKTKTRIKK

SEQ ID NO: 6401 - protein, 28 aa, synthetic construct
KLKFFQKLLKYMTRLGWRAHKAKAGIKA

SEQ ID NO: 6402 - protein, 46 aa, synthetic construct
FFRMLKRLLRRFRRCGRLVSKALINALKRRKNRWMLKNLLADARVG

SEQ ID NO: 6403 - protein, 54 aa, synthetic construct
KMKIIRRWLRFFRCKCHRFVQAPKAHAAHRTKLRALKDRAPHKDAWNLKALMKK

SEQ ID NO: 6404 - protein, 66 aa, synthetic construct
RMKLFPKLMKYLTCQRERRERKLCQMAWFLTRRLYRMKRRRDRYLWRLGYLALLGALQLQYNARRN

SEQ ID NO: 6405 - protein, 23 aa, synthetic construct
RIRFMTKLLKRIKKAPSAAQPAA

SEQ ID NO: 6406 - protein, 22 aa, synthetic construct
LFRYLKKFFRYLKRLEGRAMLP

SEQ ID NO: 6407 - protein, 24 aa, synthetic construct
RLKLWRKMLRRWSKAALLWAKMYF

SEQ ID NO: 6408 - protein, 24 aa, synthetic construct
RMKLWCKLWRRICTKAAKAELKNC

SEQ ID NO: 6409 - protein, 58 aa, synthetic construct
KMRYFRRLIKFFSPCLGWARKFKKREKLLILHRLRMFGLPQIELKKLWLIEKAAAKLC

SEQ ID NO: 6410 - protein, 52 aa, synthetic construct
RLKIYKRWIKRLRKGLCKIALLQARMAMQMRNRRAARCSEAYLTRGQRPRSS

SEQ ID NO: 6411 - protein, 52 aa, synthetic construct
KFRWLQKYYRMWRQAGQTAAACKLAPFKRHFTRLAARCRRRKLDKHYRATLY

SEQ ID NO: 6412 - protein, 57 aa, synthetic construct
LLRLWKKLMRYLRTKVVRARARERAAERRGGRREFDKIALLCLHSLACLKIIAWQHE

SEQ ID NO: 6413 - protein, 95 aa, synthetic construct
KFRWLCRILKKICKIRARTRQWLLKAMLAKRPKRVLAKKMKAFRKLYLLAVAAARRHLPIKAARYLRATIEPGAANDRGILRSVWSGPSEANAQQ

SEQ ID NO: 6414 - protein, 31 aa, synthetic construct
RLKLLTKFWKRFQRRLHSLALVMRYRAKKAK

SEQ ID NO: 6415 - protein, 27 aa, synthetic construct
KLKLLTKLLKRFTRAAGPMKVMATDVA

SEQ ID NO: 6416 - protein, 44 aa, synthetic construct
KLKLISRLIKLFQRAAHLFKCDFGNAKRAYTRLAKQNGALRQMR

SEQ ID NO: 6417 - protein, 94 aa, synthetic construct
RLRILKKFYKRYSNHRQNLRKKADGAPYRATYLIKRRCKIKARDLVHRKLKVSNAMAKQMKAGLSHSKLEEAYLLRWQNKAARLCRGKLKKHKL

SEQ ID NO: 6418 - protein, 25 aa, synthetic construct
LFKILKKLLRYMCKFRFLEAHWSRK

SEQ ID NO: 6419 - protein, 39 aa, synthetic construct
LFKYLKRFFRFFKRAALNLKRDLAKAWFNAAQFKLRANW

SEQ ID NO: 6420 - protein, 55 aa, synthetic construct
RLKFLKRLFRLMRKKRLYLMDSTKRLEALFYIFGDRRCLLKAHCAVAKLKGKMLL

SEQ ID NO: 6421 - protein, 63 aa, synthetic construct
LLKFIRRFLKMFRSKKRLACRWIMLLLLMIDKKICVAPNRNLRELAPRRDAQCLIRRFLAHRK

SEQ ID NO: 6422 - protein, 65 aa, synthetic construct
FLKLFKKMYRLFTRSFSAQKLRHALLKAIALDHYGKKLLKSLILKKCNALCARARMAPRITSVKF

SEQ ID NO: 6423 - protein, 41 aa, synthetic construct
RYKLMKKLIRYWCRKAGFLAAQLAIHLRRDADRLPRTKSLL

SEQ ID NO: 6424 - protein, 35 aa, synthetic construct
KLRLMKRFLKKIRKMKLVLQANTIAALLRAHDRDL

SEQ ID NO: 6425 - protein, 32 aa, synthetic construct
FMKLLRRLIRYMCTKAKAWMCLKARGMRRKGA

SEQ ID NO: 6426 - protein, 80 aa, synthetic construct
KWKILRKIMRRLKKLHLALRLLTNRKVNMLKKDFWMYARKLKNKARRLPHRIWCALTVREALHLLHGIKHKPQNEALERS

SEQ ID NO: 6427 - protein, 42 aa, synthetic construct
FMKLIRKIYKYLRRRLTLHRKALECAVAGLYLHWEKLQLALM

SEQ ID NO: 6428 - protein, 43 aa, synthetic construct
MLRLMKKLFKRFRRSFLRCKLHNALLRCFTKARKAKIHCWYAW

SEQ ID NO: 6429 - protein, 20 aa, synthetic construct
YIKYLKRLLRMWSKKAAAFM

SEQ ID NO: 6430 - protein, 36 aa, synthetic construct
KWRLLCRWLRRLNRKIAARLCAVCYWNAGKPRTPSK

SEQ ID NO: 6431 - protein, 40 aa, synthetic construct
FLKYLKKFMRMLRNALRLWMVRQKLVLKWAKWECLCRDAY

SEQ ID NO: 6432 - protein, 22 aa, synthetic construct
MMKLLQRLIKFLRHCAAGRTLR

SEQ ID NO: 6433 - protein, 100 aa, synthetic construct
RYRFWPKWFKRWTRRKAYHLRFRRPAALEKISTMFNALSCQLGLGHQNRAYAYAKLSDSKRALLLALKFFKKTRFWLKALPRVKYRGRRKAKLLVKLDFR

SEQ ID NO: 6434 - protein, 34 aa, synthetic construct
LFKFLKKYIKLFRRTKMLLLRKSQQMGLAVEPKR

SEQ ID NO: 6435 - protein, 81 aa, synthetic construct
KMKMLSRMFRLLRKGYLLRRLETDYKALNKCAACAKRRAHKLRKIKARLAAYDIYLYKARGFSQLRHMELFDPHKQVLYRA

SEQ ID NO: 6436 - protein, 88 aa, synthetic construct
RYRLWKRIWKRMTKVTLAAWRGAKLKKRLNDLYKFKKKLRKWQHALFAYTTPRDGARKKATARRALTSMKKWGFTLSGLTLWTAALEA

SEQ ID NO: 6437 - protein, 50 aa, synthetic construct
WWKYFRRFLRLIHRCRVACRLPKKKLHKARATGCAARMLESKDIDLQLLL

SEQ ID NO: 6438 - protein, 100 aa, synthetic construct
LLKYLPRLMKRFTTHAVNKYKLLLRRKTAAKNRYATCQPLRLLTKRPNHHLLAKKLQHQAHLERQCYKRCWFNKCAAECAAGRDAHKALALCAHFGKLEL

SEQ ID NO: 6439 - protein, 63 aa, synthetic construct
KFKFLRRYWRKLKKMTFYQKLLKMRCRTLLDRLFKKQGGGLLGFRYLAEHLDADLAKKAIACR

SEQ ID NO: 6440 - protein, 44 aa, synthetic construct
KIRLYPKLLKWFKKHHAQRMMLLYKLRHELKRALPPAKCLFILK

SEQ ID NO: 6441 - protein, 21 aa, synthetic construct
LLRFLKKFLRMYRQAFGRRVT

SEQ ID NO: 6442 - protein, 29 aa, synthetic construct
IFRLLKKLIKLLHTALRWYHRISLDKKFA

SEQ ID NO: 6443 - protein, 39 aa, synthetic construct
LIKFFRRLWRWYTQFAKRCLWRKLLFFRKLRIKAALYKL

SEQ ID NO: 6444 - protein, 56 aa, synthetic construct
LMRFLCRLWRRLKPIALLLIMMLRSWKRRCPACIALREDSSKKKKVIRTLSGKLAM

SEQ ID NO: 6445 - protein, 32 aa, synthetic construct
FLKILSRWWRILTTRRAAKVLGHVGKARLYRK

SEQ ID NO: 6446 - protein, 29 aa, synthetic construct
KWKILNKMLKRWRKRLLHAYMAQLAYRQK

SEQ ID NO: 6447 - protein, 68 aa, synthetic construct
KIKLFKRFFKLFKRMATPYYAASSNPDACVCLKQKLALQAKAKLNVILPALAATRRLKEAFVRANAYK

SEQ ID NO: 6448 - protein, 36 aa, synthetic construct
RYKLFKKLFKLWRTKMALRRWAWKRDSLNHSRLQHL

SEQ ID NO: 6449 - protein, 87 aa, synthetic construct
KMRLFNKFFKRWSKRGRCCLLIQYRCAPLTRREDKWKRLLTLARWPLLRVYDLMMAIQLKRAAKLQLLKKPKNKQNAAKAKLLRTAR

SEQ ID NO: 6450 - protein, 72 aa, synthetic construct
RFRMYCRIFKRIRTLRAAPLKVHKAIRATLRRDPAKRKRQLKAKLSEAHAHVGAKDKLCALCYRTLAHFEPG

SEQ ID NO: 6451 - protein, 49 aa, synthetic construct
LFRYLRRWIRFLRRAKAEGLRLNYAKRASLLRLHITLGKLPKAKCAYLC

SEQ ID NO: 6452 - protein, 59 aa, synthetic construct
KYKILKKLWRRLKPFRFLRVKDRMVASAKNRIAYYAAERRTNECAEALALLYAQSKLRC

SEQ ID NO: 6453 - protein, 86 aa, synthetic construct
FMKLMSKMIRFFKKKKCKKAREIRADKSIDLRRRTHLKISALDAAVCRLLRARSIKPGDDARTLLYKLISEKKAKRPLKNCACLHR

SEQ ID NO: 6454 - protein, 34 aa, synthetic construct
RLKWFKRLMKKLPHIRFRAAASMRALVYTRWPRG

SEQ ID NO: 6455 - protein, 23 aa, synthetic construct
RYKLFKKFLRMLKTTAHLAHKQF

SEQ ID NO: 6456 - protein, 36 aa, synthetic construct
WLKFWSKLLKLIPKLLAQGKNAWAKDAPTKRAKKCE

SEQ ID NO: 6457 - protein, 24 aa, synthetic construct
KLRLFKKFLRLFPTHWEKLYFLLR

SEQ ID NO: 6458 - protein, 46 aa, synthetic construct
LFRMLCRWLRKLKPKDNDAVAGASSKRLKLYGRSVMIRATQRLLAR

SEQ ID NO: 6459 - protein, 78 aa, synthetic construct
FLRMLCKLIRRLRRCRTVRRQKGHLKELLAWLPARFELAKVARKRNAHCGKKQLVFRKARQQMKALIGNAEAVMMRLL

SEQ ID NO: 6460 - protein, 20 aa, synthetic construct
RFKMYKRLMRLLQRMGKTAL

SEQ ID NO: 6461 - protein, 40 aa, synthetic construct
RLKFLKKWWKKWNRLSRKAWIALLLRRRGKDGKWTLGLAV

SEQ ID NO: 6462 - protein, 70 aa, synthetic construct
LLKFMKRWWRKIRRRKKAIATQNLAKRALNRSFDKLRKSWNRRDALEYAIAKIQARHKGDCRLRGYITLP

SEQ ID NO: 6463 - protein, 54 aa, synthetic construct
KFKFLTRLLKLFKCAAACKLRRREKLKCPKCREYAKWAYLLLRQVASADERVIG

SEQ ID NO: 6464 - protein, 29 aa, synthetic construct
LLKMIRKLFRRWQNALRVLRAHRMMKHLR

SEQ ID NO: 6465 - protein, 39 aa, synthetic construct
LLRLLQRMIRILHKAARAQSVELMRASERKILKKRTPIR

SEQ ID NO: 6466 - protein, 30 aa, synthetic construct
KLRFFSKILRRFKRLAKAWHAQSGYRALHR

SEQ ID NO: 6467 - protein, 87 aa, synthetic construct
KLKYWCKLLKKYKKKKVIKLLQARALLQRRAHKLNISLKFKDPEYCKRLAKLRKKPFYKGLRWCKHAVPNPLTRKLAAKAVHAKQYC

SEQ ID NO: 6468 - protein, 33 aa, synthetic construct
RFKYLRRFLRLLKRLNRVNALPRSYACKLLHAR

SEQ ID NO: 6469 - protein, 63 aa, synthetic construct
RYRLLHKFIRYLRQRMKNAKRLNAEAAGANRWAIARSNPGKRRSKVLLAFKNRAAVRRWRDFR

SEQ ID NO: 6470 - protein, 27 aa, synthetic construct
KLRFFKKLMKKLKHRAMASVLLAQLHL

SEQ ID NO: 6471 - protein, 70 aa, synthetic construct
KLKLLHKLYKFFKSGLKNAFPLKLARHPFRSRLKLYLLRSELRLKAAWLVECRKQALCLKSTCDFIYANC

SEQ ID NO: 6472 - protein, 54 aa, synthetic construct
LIKMYCRLLKKLRSADLVKASLAWDANQRARAAEDARRDCALRKNACIVKGTPH

SEQ ID NO: 6473 - protein, 56 aa, synthetic construct
YWRWMKRMLRLMHKRFYCLDEHLARLAKILDKIRALTFRMAAVAGLANILTAARRF

SEQ ID NO: 6474 - protein, 34 aa, synthetic construct
LYKLFNKFMKRFTKARACKWMKDLLQSAKCKLLQ

SEQ ID NO: 6475 - protein, 29 aa, synthetic construct
FLRLIKRFLKLYKNPGQAQGLHKAAWLKV

SEQ ID NO: 6476 - protein, 34 aa, synthetic construct
YYRLFTKWLKRFKNQKAAAWAAKAWPKARAMRKA

SEQ ID NO: 6477 - protein, 36 aa, synthetic construct
KFRWLCKWYKRLKRRALRALLALRCRSRKSRPSLQL

SEQ ID NO: 6478 - protein, 71 aa, synthetic construct
KIKFYRRWYRKLRQGLKLPPKDAEIMASAVARCYQAKRARRNRKNARKITVGQKAPLVSAKLAFLKRMAAR

SEQ ID NO: 6479 - protein, 59 aa, synthetic construct
WFKMLRRILKKMRRTMAKARARINYRKMRLTRDLLQALDKLLRRLDLKAKKTIDKELAS

SEQ ID NO: 6480 - protein, 74 aa, synthetic construct
LFKLFRRWLKKIRKHWRHYQGATILHRNLLDAALALAAAAQVCKKRKKKNANRDWIFERLSYKVRDRMQRKAST

SEQ ID NO: 6481 - protein, 22 aa, synthetic construct
KLRMLKRLMRLLHKFVLTQRLC

SEQ ID NO: 6482 - protein, 31 aa, synthetic construct
KLKLIPKYLKFLPRRYYDKWKALLARFAARL

SEQ ID NO: 6483 - protein, 55 aa, synthetic construct
RFRLYSKIIRRMRRRNKAARGHALFSARKAMLKKVFKYSGTATTGMHLRLALRPA

SEQ ID NO: 6484 - protein, 29 aa, synthetic construct
RLRFLKRLWKLIKQTGCRMAPLGAALWRK

SEQ ID NO: 6485 - protein, 35 aa, synthetic construct
FIRFFKKMIKLLRSAHMRAVQERKRRYAARLCHLL

SEQ ID NO: 6486 - protein, 23 aa, synthetic construct
LLKIIRKLLKFLKHAERVRLCDA

SEQ ID NO: 6487 - protein, 54 aa, synthetic construct
KFRFLSKYLRKMHKKRNTRYPLRALNWLSKELIIALDHKLARLEERLMKPVRTL

SEQ ID NO: 6488 - protein, 70 aa, synthetic construct
KYRMYKKLYKLIRRRSPHDKKNVYMHEYALCKRAADLMLGFKLLGALDKKQKADKKIRPLAIRLKHLEKM

SEQ ID NO: 6489 - protein, 33 aa, synthetic construct
LYRWLRKLFRKLKPNKQMTLYRAACASLHCKRH

SEQ ID NO: 6490 - protein, 54 aa, synthetic construct
KLKILRRFIRIFSPLATAKAHREKKIREKWASRLLLKRPNHLMRTLGDLKASMT

SEQ ID NO: 6491 - protein, 95 aa, synthetic construct
LFKWINRIFKRYKQKFQARKDARRLASWHAACLRRRFKYYIIRLAIRSLKAIKVKLRLFANRGVNIARWIQKLELMVKRRSLHAASRKALHAATG

SEQ ID NO: 6492 - protein, 29 aa, synthetic construct
RFRFLNKFLRFLKRKYALHLQFAARAWRG

SEQ ID NO: 6493 - protein, 29 aa, synthetic construct
LYRMLSKLLRLYRSHLEERVPCHARRLKR

SEQ ID NO: 6494 - protein, 28 aa, synthetic construct
FLRLFRRMLRLMQRKRRSKTLILTKLDL

SEQ ID NO: 6495 - protein, 77 aa, synthetic construct
RIKILQKFLRKLNRHNWKRKARRHDCCPLRRCKRILHAKAVLFLPYLLTRCRRAQGRWCYKKLKCRLARTIRALAFF

SEQ ID NO: 6496 - protein, 46 aa, synthetic construct
LLKLFRKYLKRYRKERGQPALHWLLRNILETLEWLCTKMGRKDALK

SEQ ID NO: 6497 - protein, 52 aa, synthetic construct
RWKLWSRLLRLMRRRRDKIARYHRARMLKDERRTPAITTAHLYDMYDAKTRL

SEQ ID NO: 6498 - protein, 65 aa, synthetic construct
FLRFIKKYWRKLNKSMECLAKLRAMDLGALNGTKKRLLLLEISTRILALKTGMRLAKWPTAGKAP

SEQ ID NO: 6499 - protein, 33 aa, synthetic construct
LLKLFNKLWKFLHQLWARKARRSRMCLAQHFRN

SEQ ID NO: 6500 - protein, 25 aa, synthetic construct
RLRLLHRWFRIFKCANKAAIKAFSR

SEQ ID NO: 6501 - protein, 20 aa, synthetic construct
KLRFINRFLRMWHRALGMLK

SEQ ID NO: 6502 - protein, 27 aa, synthetic construct
KLKFITKMWRFLKKKAAQMRAILGREL

SEQ ID NO: 6503 - protein, 34 aa, synthetic construct
RLRWIQKLMRRFRRMAQWLKWLRAGINLRNLAIT

SEQ ID NO: 6504 - protein, 39 aa, synthetic construct
YIRLLRKYFRKFRTDDASKRRAAKLRMNAPLKPCTCAAK

SEQ ID NO: 6505 - protein, 44 aa, synthetic construct
KFRLIKKWIRLLTKVARLRDLKFKHSHLMRTWLQLAARLFRKGK

SEQ ID NO: 6506 - protein, 22 aa, synthetic construct
RLKLWKRWFRLYKRKLWCETAA

SEQ ID NO: 6507 - protein, 47 aa, synthetic construct
KLRLLRRMLKFWSRRKACNLGWDREDKARGANLAYCFHLRHFLRERL

SEQ ID NO: 6508 - protein, 25 aa, synthetic construct
RYRWFKRIIRLLKKIQHLPLALALA

SEQ ID NO: 6509 - protein, 56 aa, synthetic construct
RYKYYKKMFRKLKKRKLLTKGALRRRLKVADSRMLPWHLEASLPLIIGIKMKDPIA

SEQ ID NO: 6510 - protein, 60 aa, synthetic construct
FLRIFRRMLRWYRKAARPMRAMRPMRLELDSWGSLLIIRHQRHVREALERRKLIRLDLKA

SEQ ID NO: 6511 - protein, 47 aa, synthetic construct
RFRFWTRLFRFFCRTAYRCADAKIKKLTFAAILRFPCLAYRKKARKP

SEQ ID NO: 6512 - protein, 50 aa, synthetic construct
MLKYWKRLLKLFKPKRIRLMWLVLRKADYNNDQLKNKRNRYLIAYKDKYA

SEQ ID NO: 6513 - protein, 42 aa, synthetic construct
YYRLLRKLYRILRRRKDWWHREKLKLLYSPRNLKTFILTGKA

SEQ ID NO: 6514 - protein, 46 aa, synthetic construct
KLRMLRRFIKRMKKALQHLKLLKKYTKLYCKWHNMRAALVLAAKVA

SEQ ID NO: 6515 - protein, 21 aa, synthetic construct
FLRFIRRLWKLLTRADPMARH

SEQ ID NO: 6516 - protein, 43 aa, synthetic construct
KIKFFRRILRWLCRLMVYKCANSAHWLLNFAARAKRKRLWNLY

SEQ ID NO: 6517 - protein, 56 aa, synthetic construct
RLKILSKLLKKYCRRSSARPKLQKAKLRAHWASPLMQGRQMLTRIAFKMLDARAKK

SEQ ID NO: 6518 - protein, 45 aa, synthetic construct
RLKLIRRLFRKFKKFRFYGLTALKQYADRLDRNLAINLLNLMRHY

SEQ ID NO: 6519 - protein, 27 aa, synthetic construct
KFRLFKKYLRLLKRWGMLLGTAKFAGT

SEQ ID NO: 6520 - protein, 30 aa, synthetic construct
RLRYWPKLWKKMRRKFFNLLACARNSWKLP

SEQ ID NO: 6521 - protein, 65 aa, synthetic construct
WFKFWNKFWKKLTCRLNCAVKFLAVCRNAKRAKKLFLRLKASKKDARHENAWRLAMRLDADVHRL

SEQ ID NO: 6522 - protein, 29 aa, synthetic construct
LFKLWCRLIKKWKNNSRRDQHLKCACAAR

SEQ ID NO: 6523 - protein, 41 aa, synthetic construct
RWRFYQKLIKRWRHAPPCLKLSLFFLAALLWKASLLRGKQS

SEQ ID NO: 6524 - protein, 58 aa, synthetic construct
FIKYLTRLMRRLPRLNLCLLMRAWPRLMEKLWLHDEWVRKRPAFLKWLLLMKIQPKKL

SEQ ID NO: 6525 - protein, 30 aa, synthetic construct
RIKILKRLIRKLTRCALLTRLYWLRGAGRQ

SEQ ID NO: 6526 - protein, 44 aa, synthetic construct
RMRLFRRFLKRIRKLDKAHLAVRPLATADARRLKKAKKRGVLQW

SEQ ID NO: 6527 - protein, 20 aa, synthetic construct
FLRILKRLWRMWRCQLAADV

SEQ ID NO: 6528 - protein, 45 aa, synthetic construct
KLKLWRKWFRLLSRRRLTRPLTSALTRACYESRRKTGYCAERQLT

SEQ ID NO: 6529 - protein, 58 aa, synthetic construct
IWKYYRRLWKRIKKAHALNKRACSLAEARKRLACSEEAGKFSHLCRKRAKPRACWEYR

SEQ ID NO: 6530 - protein, 24 aa, synthetic construct
LLRIWRKLFRYMKNKLAPSLAAKL

SEQ ID NO: 6531 - protein, 27 aa, synthetic construct
KLKLLKKLWKKMHSARENMIRLLAQPS

SEQ ID NO: 6532 - protein, 48 aa, synthetic construct
RFKYWRKLLRMFSKCSAYAACATARYLRSKFALLALELFNHMARFRKW

SEQ ID NO: 6533 - protein, 32 aa, synthetic construct
FLRFLRKLLRRYPCAARIRASHLYANCRKPKS

SEQ ID NO: 6534 - protein, 25 aa, synthetic construct
KMRLFKKFFKRMKPVRYLLAWVLHA

SEQ ID NO: 6535 - protein, 63 aa, synthetic construct
MWRLLKRLYKIWRRKIKLDLLKCGKLECAGRYLMMKSAAKQGFKSNAKKKFLRSALTPSFLPK

SEQ ID NO: 6536 - protein, 25 aa, synthetic construct
FLRLFNRLMRRYKQAADRRSEIRIL

SEQ ID NO: 6537 - protein, 58 aa, synthetic construct
IMKYLKRYYRRFSRSWGNKKLCARSAALLVQLKYCVLMKARGLLLRGKKSARAKKRAN

SEQ ID NO: 6538 - protein, 50 aa, synthetic construct
KYKIMKKFIRKYKKFWEKLARAAQRKALLIRKKLVALAASSCHAHFLEFV

SEQ ID NO: 6539 - protein, 37 aa, synthetic construct
RLKWWQRIYRLYRRALDYLCNAWKRRGFRMNVAALKK

SEQ ID NO: 6540 - protein, 36 aa, synthetic construct
RFRFFQRWYRKFRRPTRLFKADDAYALLLLAAWMYR

SEQ ID NO: 6541 - protein, 32 aa, synthetic construct
KMRLLCRLMKKLHHIRLMKKLGDFRKLLDWGA

SEQ ID NO: 6542 - protein, 28 aa, synthetic construct
LLRILRKLFKKIRRLAAKVCACCKVTAH

SEQ ID NO: 6543 - protein, 79 aa, synthetic construct
RLRMYKRFFRKFRNENHFKRTPNDERGVRPLLARRQHREACLKACGAKLDKAVALTAARLRHSAKNASIATACARAKLV

SEQ ID NO: 6544 - protein, 63 aa, synthetic construct
RIKILNKWLRKFHRVFWLAKPRVRKAPKKCRWGLKLRGGAWRKDLVRAQLLKAVLFDAAVWYM

SEQ ID NO: 6545 - protein, 29 aa, synthetic construct
KLKFFRRFLKRLQKPWCMLLAKLMSKQLH

SEQ ID NO: 6546 - protein, 35 aa, synthetic construct
KLKLWCKIIKFLRKAIRMRCKRLKQIVAYSAASEA

SEQ ID NO: 6547 - protein, 34 aa, synthetic construct
ILRILRKFIKKIRPLRFWARAFLHALQKYHLKKK

SEQ ID NO: 6548 - protein, 48 aa, synthetic construct
RFRLMRRMLKRLRRQLLALVTMFLHAIAWKREKRWVGQIALAYARCDQ

SEQ ID NO: 6549 - protein, 25 aa, synthetic construct
LLRYLPKLLRRYTKWTSAARVAKRV

SEQ ID NO: 6550 - protein, 33 aa, synthetic construct
LMKLYSRYLRIFQKDKWRVKDALRLAKYPLACA

SEQ ID NO: 6551 - protein, 62 aa, synthetic construct
KFKMLRKFFRLLRKNTPSAHKGKMQLRAAGNRRLFKRTMLLKLPKLKIQEFLLASKMKVGKK

SEQ ID NO: 6552 - protein, 60 aa, synthetic construct
LFKILCKLFKWYRNKAKSARHRADKFGKVRKRARPRIKRLEIEQAASDRLEAMSWLLLYR

SEQ ID NO: 6553 - protein, 20 aa, synthetic construct
IMRLMRKFIKLLRNLATRKC

SEQ ID NO: 6554 - protein, 37 aa, synthetic construct
RWKMWRRLLKKFKHYRYAKLSPSFAIWRMTLHKLLLR

SEQ ID NO: 6555 - protein, 26 aa, synthetic construct
LLRIFRRILRMLNRPKEFLKHLLKCV

SEQ ID NO: 6556 - protein, 52 aa, synthetic construct
LLRWMQRYFRFLPKLALFKGPPKKLKDNHRNAAYCRRVRAKKRAISILRLAY

SEQ ID NO: 6557 - protein, 38 aa, synthetic construct
LLKMFQRLLKFICQLKARKACARRRERANYAKKLCEYL

SEQ ID NO: 6558 - protein, 29 aa, synthetic construct
RMRILTRFLKYLRKKARAYMLCNHLAARA

SEQ ID NO: 6559 - protein, 25 aa, synthetic construct
LLRLFHKYFKKFCRNQWKELAKAKF

SEQ ID NO: 6560 - protein, 44 aa, synthetic construct
RIKFFQKILKLFTRAHIQFWKAKADYKTREFKLNALKRLALCRK

SEQ ID NO: 6561 - protein, 47 aa, synthetic construct
KFRLLKKLLKFLKKGDSKAACNALKKTDKHVTSVLRKLMALWSNRKR

SEQ ID NO: 6562 - protein, 32 aa, synthetic construct
RLKFLRKMLRFLQKLQCKMMLDIRKNLGKSAH

SEQ ID NO: 6563 - protein, 36 aa, synthetic construct
KLRYLSRYLKMLKKRLAECIEKLIRVKLLPCALKFD

SEQ ID NO: 6564 - protein, 39 aa, synthetic construct
WFRWIKKLMKIWNSARKIRLGRHWALALKLAPLARKNRA

SEQ ID NO: 6565 - protein, 38 aa, synthetic construct
FLRMLRKILRFITTALGSLIRQGNLKRLAKALKNDKQK

SEQ ID NO: 6566 - protein, 27 aa, synthetic construct
RYRYLKRLLRRFCKHWIEKRNLLQLAF

SEQ ID NO: 6567 - protein, 43 aa, synthetic construct
KMKLFRRLYRRIPRPSRPALRYKHSKLVKMANKAFNADVAALF

SEQ ID NO: 6568 - protein, 29 aa, synthetic construct
LLKLLHKYMKMMRRDAVRHLKKHDPCGAK

SEQ ID NO: 6569 - protein, 34 aa, synthetic construct
LMKWLHRFIRKLSRAKRAYAEVLSWGAKTKAYAQ

SEQ ID NO: 6570 - protein, 88 aa, synthetic construct
LFKWLRKLIRYIKRLKYYTKQRLQRVMMQWFFMEKQYVARNKSLLLAKYACEHKLRRKGARELRSAAMNQRLAHERACQQKAKKKRLA

SEQ ID NO: 6571 - protein, 20 aa, synthetic construct
WLKMMKKLLRKLPRLPLQAT

SEQ ID NO: 6572 - protein, 61 aa, synthetic construct
WLRMLRKLLRRIRKKDGLYSKIKLKWARIAFGAGGYSAWSNVRVCKRGKARAAQRFLKQEK

SEQ ID NO: 6573 - protein, 92 aa, synthetic construct
KYKFWRRLFKKIKKKWLLDRGRNNNRAKIKETAKLRKNPDLLGMHAAWAHAKRNVAMLTYLAKYLGANKKDLRSLPTLQRKDKIKRWVKKTP

SEQ ID NO: 6574 - protein, 29 aa, synthetic construct
LLKFFRKFLRRWQTFKRLAKAAFADLELM

SEQ ID NO: 6575 - protein, 51 aa, synthetic construct
WLRYWRRILRKFKKPDLALAFKAAFWGAKILGMLRALIKHTYLKGNLKRNI

SEQ ID NO: 6576 - protein, 28 aa, synthetic construct
FLKFYKRMFKRWRSAALCLKLKRVGALR

SEQ ID NO: 6577 - protein, 38 aa, synthetic construct
KLRLWTRIWRRLQKELHLWLVKKKPLRARMWGLACKMM

SEQ ID NO: 6578 - protein, 23 aa, synthetic construct
LLKLIKRWFRLLSKWCKGHLRKM

SEQ ID NO: 6579 - protein, 83 aa, synthetic construct
KLKMLKKYLKWLKTFKLKVCEARQSRKWGRLVLMLRARLLLRYQHHSTDVLGSKLKFVLKPRIKLKAKLWLWERHELFHGRTR

SEQ ID NO: 6580 - protein, 36 aa, synthetic construct
KLRLLTRWLRKFKSGVLLMRMGKGAKITLAALLHKK

SEQ ID NO: 6581 - protein, 56 aa, synthetic construct
KLRMLKRMIKKYPQYMTAEKRLLAIAKALLRKKKAGLVKALCYYKVYRSHFIISVK

SEQ ID NO: 6582 - protein, 48 aa, synthetic construct
FLKMLKRLWKLLNKRALIADKYAAAASKYCKKMTRGACHSILQIKLKQ

SEQ ID NO: 6583 - protein, 62 aa, synthetic construct
LLRFMRKLIRLIKRAKGTKRAKKWELRGAYKRRLKIRSAAKQHHYAFALLMCCLLLRACKDD

SEQ ID NO: 6584 - protein, 34 aa, synthetic construct
LLRLMRKLLRKMKRAWDHSERPRALLPARPCGHS

SEQ ID NO: 6585 - protein, 20 aa, synthetic construct
KFRIFKKLLKKLNCWFQKAA

SEQ ID NO: 6586 - protein, 81 aa, synthetic construct
RLRWLKRIYRKYKNYANRGILKPLTKLRCRTRREPRDLHLELQYKLLAKLPASYWTLAAEMKLHVKLVMQYGALFAKALKN

SEQ ID NO: 6587 - protein, 77 aa, synthetic construct
FFRLMKKLMKYMKKLLYHAKLEKCLHALEKLKMLAGKARAQKKTAVIKWLDRYSCTLRRRVGLAAVAKHHPNKNLRQ

SEQ ID NO: 6588 - protein, 71 aa, synthetic construct
KIKMLTKFMKYIKPRKKRLIRAKCGANKYRCAAKNLLRWACARKQADNLSLLKKWAKLKHAWASQAAACRQ

SEQ ID NO: 6589 - protein, 21 aa, synthetic construct
RLKILRRMFRRFCCRASLSLC

SEQ ID NO: 6590 - protein, 92 aa, synthetic construct
MWKLLHKFLRFIPRRKRANQRAGLTRLAKKAAAKALKQLMYRAMNLMTMDALRLLRITKVQLMRIKPPAPKWKCADHCWKNLTAKAIALLLL

SEQ ID NO: 6591 - protein, 81 aa, synthetic construct
KMKFLSRYMRRFSKEDTLPIKYRKRMTKQIAPLDRRTWALRKAKKRAKLKSWLLCEVWARLLAAKKLTPKAPNGWLPLMKI

SEQ ID NO: 6592 - protein, 47 aa, synthetic construct
FFRFIRKWIKLLRKSTAARCKKGCMAAMFKARFYMKANKADGKLKPA

SEQ ID NO: 6593 - protein, 43 aa, synthetic construct
FLKLIRRLFRRMKKLKMKTAKIINLIRLREPSQFLKTALFHKF

SEQ ID NO: 6594 - protein, 40 aa, synthetic construct
YLRLYRRLWKYLKKASMAVANKKRAKYMCRYTMLVERACI

SEQ ID NO: 6595 - protein, 36 aa, synthetic construct
MWKWWNRLLKRLNRRLYRARLNYAIDWAIDLKLCLL

SEQ ID NO: 6596 - protein, 23 aa, synthetic construct
LLRLFKRFYRYLRRALKLMKLDA

SEQ ID NO: 6597 - protein, 66 aa, synthetic construct
LLRFLSKLLKRMKRKNIRALMLKMALEFAALKKGKKHNLHNLAGAKQANNPTQPKLLDYRDQLATV

SEQ ID NO: 6598 - protein, 42 aa, synthetic construct
IYRLLRRLIKILHNRLFKVRLWYKLLKWVKATKIRVMLKLCR

SEQ ID NO: 6599 - protein, 58 aa, synthetic construct
LMKLLKRFYKKLKKEWALKRPLNGYTRLKLANPQRKSCRVRAWALMAFLKVLDQRTRM

SEQ ID NO: 6600 - protein, 43 aa, synthetic construct
RIKMLKRMLKFWRTKRLAKIKANLMCALAWILRVHNRANNWAL

SEQ ID NO: 6601 - protein, 59 aa, synthetic construct
KMKMYRKIYKRLRRACLSRERKKLRKYNADMAWLRLHLRERNHRKHAAAALAAECLHLW

SEQ ID NO: 6602 - protein, 46 aa, synthetic construct
WFKLMRKFIRYLQRRRLGFCHAAKRREKAWRAKGLLTKVMKAAKAQ

SEQ ID NO: 6603 - protein, 38 aa, synthetic construct
FWKFLKKFLKRLRHGRLCNKTAALFKALKWGKLPDKFL

SEQ ID NO: 6604 - protein, 30 aa, synthetic construct
RFKLFKKLFKWFRPKALMARGAPTKRDAEY

SEQ ID NO: 6605 - protein, 29 aa, synthetic construct
LLKFLKKFLKRFKPTKKNTLDNAREYALY

SEQ ID NO: 6606 - protein, 34 aa, synthetic construct
MLKWLQKWWKKLHSRRILMKRKAMLARCDVYAMK

SEQ ID NO: 6607 - protein, 58 aa, synthetic construct
WYRYYKRMFKWWRRDRWFALRWLGGNARALRAAKISALALHQAQWLFLNAKRKKSKAG

SEQ ID NO: 6608 - protein, 57 aa, synthetic construct
LLKLLTKWLKILKRKFKRCVQRCSKHRAVQICARLVKAQWYPRKLKKSKRHAAAHYH

SEQ ID NO: 6609 - protein, 31 aa, synthetic construct
KLRLLRKIFKKWKHKAPWEARKAASAIHPTS

SEQ ID NO: 6610 - protein, 45 aa, synthetic construct
LLRWLSRLWRILTKCPLQRAEREKMAKKPNQKCRHLLMCKACKPA

SEQ ID NO: 6611 - protein, 45 aa, synthetic construct
RIKFLRKYYKRYNKKKLGDTAKFNADLKRFDGKLMIILAMALQLL

SEQ ID NO: 6612 - protein, 47 aa, synthetic construct
FLKLIPKYMKRFKKKALALRDAQMKRGAMWDSRIKTRTVADLAPLIL

SEQ ID NO: 6613 - protein, 77 aa, synthetic construct
KWKLLPRWYRLWKRPARTDARWKEHTHKPRDPVTLLALDRAALILIASQLFACLRLRLERVLLKQQLALEWHRIRKK

SEQ ID NO: 6614 - protein, 80 aa, synthetic construct
LLKLIKRFLKKLCKRALLGLSATKLPTARDDMLICVGEAPPWGLRPKRLANWRKARTNAAALLLRRRRRSFLGNAEWRGF

SEQ ID NO: 6615 - protein, 54 aa, synthetic construct
RIRIFKKMMRKFRCLMALWWLRVRAMTACKKYGAMAARDRARAAAAESAGKALF

SEQ ID NO: 6616 - protein, 49 aa, synthetic construct
WLKFLKKLFRKLKCTCAAAKMYAGLIFAYFRARRRLERWTNKLILLVKG

SEQ ID NO: 6617 - protein, 48 aa, synthetic construct
RFRLIHKWFKILRHACAMLCFNRRSLRRAERKAIKLVLLNRLGVELRL

SEQ ID NO: 6618 - protein, 21 aa, synthetic construct
RWKLWPRFFRLINKYLLCLRK

SEQ ID NO: 6619 - protein, 31 aa, synthetic construct
WMKLLPRIIRYIRTKYKRHIAAKAAELCLAR

SEQ ID NO: 6620 - protein, 22 aa, synthetic construct
LLKLITRYLKRMSQLIKLRWKL

SEQ ID NO: 6621 - protein, 20 aa, synthetic construct
FFKLMRRFYKKLRQKAFEAL

SEQ ID NO: 6622 - protein, 25 aa, synthetic construct
IYKFLRKYMRKLKRRLGLLAVLMNH

SEQ ID NO: 6623 - protein, 70 aa, synthetic construct
RLKFFRRWLKLFKQIALYLLRHYLKIAAMRRAAWKVSLLDRFRNSNDRGRMPCARKKKEVAELWLKLARR

SEQ ID NO: 6624 - protein, 78 aa, synthetic construct
KMRLFRKYMRKIRRQRLIEGHPKDAPKWECKKQRACAAANIVALKALWAAKWDRFARWLYCQHKWRHMKYLAKRRLNR

SEQ ID NO: 6625 - protein, 55 aa, synthetic construct
LFRLIPRWYRFFKRTTALCAKAYGLKREKLLFLVSLMNKRWILKKSRARVAHRRV

SEQ ID NO: 6626 - protein, 65 aa, synthetic construct
RFKYLTRMYRKLRRSADRNLGKRCRFYRAAHKRLLKARARHRWHILVFVAHSWDSKRWLLWALLN

SEQ ID NO: 6627 - protein, 56 aa, synthetic construct
RLRLMRKIMKWLRKRKGAKKLLLLASQRLCWWDKIAYAMRYNKWLANRKKGAKAYL

SEQ ID NO: 6628 - protein, 40 aa, synthetic construct
IYRLYRRLLKKLNRKHKGKKTLLADAAELHKKNSLARAKK

SEQ ID NO: 6629 - protein, 29 aa, synthetic construct
YFKWLHKLLRRWRHQWRIANLRKNLRSPA

SEQ ID NO: 6630 - protein, 49 aa, synthetic construct
RLKFFKRFLRLMRKWAKRLRRKHLCMTFPLCLDEQLRLKALSASFTCLF

SEQ ID NO: 6631 - protein, 51 aa, synthetic construct
KFKLIRKLLRFMRKFAGGAADANAQAMALVPACNARKCATKKVLCDGNRRK

SEQ ID NO: 6632 - protein, 39 aa, synthetic construct
IFKFFRRMLRRIRCKLLKAATKYQLWKLCKAHNEKLAYN

SEQ ID NO: 6633 - protein, 36 aa, synthetic construct
KYKWLSKWIRRLKRKKQLTRLLIKLLCLNNRLDMSM

SEQ ID NO: 6634 - protein, 28 aa, synthetic construct
KIRLLPKLYRRFTRKDATLRALGYALFM

SEQ ID NO: 6635 - protein, 44 aa, synthetic construct
LYKIIKKLLKFFRRWSRHVKLEAPALIINARWLLLAGDSLRKRT

SEQ ID NO: 6636 - protein, 55 aa, synthetic construct
RLRMWKRLWKLMQHAARTRNFWRRMATIAHYERSLPRMAAALRARAYRREPQRRG

SEQ ID NO: 6637 - protein, 21 aa, synthetic construct
RWKLLNRFWKLFRKAALSMSW

SEQ ID NO: 6638 - protein, 70 aa, synthetic construct
WYRWLSRILKRFKRQAMAKWKACMLLKTFCALVNKKVALCCFLIVTASASSKATARKAAKARKRRLRKKC

SEQ ID NO: 6639 - protein, 28 aa, synthetic construct
FFRLMTRLLRFIRNRRKLGAAKAPLSRR

SEQ ID NO: 6640 - protein, 41 aa, synthetic construct
ILRLLRRFFKRMKKLLLAKKLSFRKTCVLMPSHLKYGALGD

SEQ ID NO: 6641 - protein, 20 aa, synthetic construct
KFKFLRKMYRLMQQALSARA

SEQ ID NO: 6642 - protein, 62 aa, synthetic construct
KYKYWCRMLRRIPKRKLARGRAQGLLKLMAQLAWDPDLKSCKVYTLCAMCAAQKRLRIKLRH

SEQ ID NO: 6643 - protein, 30 aa, synthetic construct
KFKWLHRMLKLWRRALTKQYAAWRTAFKIN

SEQ ID NO: 6644 - protein, 70 aa, synthetic construct
YFKMWNKFYKKMHTRWFRACLRAWGNARREMYKTKLCKKLRQAWAPNLCLKHLIKDRLRKVLLATAKKKL

SEQ ID NO: 6645 - protein, 35 aa, synthetic construct
KYKLMTRLFRLIRQAPRMFLRLLIPKKKLAVLEIS

SEQ ID NO: 6646 - protein, 24 aa, synthetic construct
IIRLFQRFLKKIRRLYLQLNAARH

SEQ ID NO: 6647 - protein, 30 aa, synthetic construct
KMRMYRRLLKRYRTLCGAKACTLDLMKERT

SEQ ID NO: 6648 - protein, 63 aa, synthetic construct
LMKWMRRMFKKYRKVKARLRSTKCLTNKKAAISMALKCSEYEYAGAHKALLHAANRKYQSRAA

SEQ ID NO: 6649 - protein, 29 aa, synthetic construct
KWKFLKRIFRRLQSLAMCAFLAKARAHRR

SEQ ID NO: 6650 - protein, 21 aa, synthetic construct
LIRLWRRWLRMLQQHKAPLHR

SEQ ID NO: 6651 - protein, 78 aa, synthetic construct
RYRLMRRFLRMIRRERNAERPAKWRARARYYGNELIYYAFTALLGWKCLLTAKQNALRELKQKLRHALQPNRLVKSLG

SEQ ID NO: 6652 - protein, 22 aa, synthetic construct
RYKYLSKMWKLFRHKSLRNLLL

SEQ ID NO: 6653 - protein, 43 aa, synthetic construct
RLRLLQKLLRLFRHTCHYRWLARFLVAECVYTLWKAKHLIARK

SEQ ID NO: 6654 - protein, 91 aa, synthetic construct
RLKFLTKLLRKIRKLLWLRWAMAWLRSNKFIPKLLGETALKMSRRSPKRKLKAFARQDPHKAAHVVLTIFPKDLDKIILVQLCWLARRKLK

SEQ ID NO: 6655 - protein, 27 aa, synthetic construct
RFRLLHRWIKLMKKNATANWQAELKMA

SEQ ID NO: 6656 - protein, 23 aa, synthetic construct
FIKLLHKLFRKIRSLEIKAWLAK

SEQ ID NO: 6657 - protein, 33 aa, synthetic construct
RIRYLKRMLRRLKKLRLLLLAGNHVLIYQLRTR

SEQ ID NO: 6658 - protein, 28 aa, synthetic construct
FYKLLKRFWKKIKKTAMRTDLSKEAAGL

SEQ ID NO: 6659 - protein, 41 aa, synthetic construct
RWKLMRRFWKRYKHLADKALLRPALDKRPRRHCPKHMQAAC

SEQ ID NO: 6660 - protein, 60 aa, synthetic construct
LLRIMNRLFRMMRRKLILLRANREMQKLLAYLRTGDKLRDGRKLVITWWLWAYRLHKERY

SEQ ID NO: 6661 - protein, 81 aa, synthetic construct
RIKFIKKLLKILTSQRMRVYTIKYALRLVLRHHRLLYPRDRKGGKKTAALKANNLSHKDAKARQRAKLLSVHKLNTERLFL

SEQ ID NO: 6662 - protein, 26 aa, synthetic construct
LLKYMKKLLRKLTSKAKKNDNEVSLM

SEQ ID NO: 6663 - protein, 40 aa, synthetic construct
KLKLLRKLFRFYKPNQEEWMCWAKNAARCNALVNLKLSLR

SEQ ID NO: 6664 - protein, 59 aa, synthetic construct
KLKYMPRLYRKWRKSFILADYKCNLALFRSTKYSAALCRTRAAWLAQFLCRFWKKLLLA

SEQ ID NO: 6665 - protein, 45 aa, synthetic construct
RLRLLTRLWRRLPRLLLRPRGRLWLAMHLSSKTRHFVLRLKMKWK

SEQ ID NO: 6666 - protein, 47 aa, synthetic construct
KFRLFCKLLRLFNHCKCIMRALIRHKRLLLYHLFARCAYATDCRARK

SEQ ID NO: 6667 - protein, 39 aa, synthetic construct
KLKFFCKMWKRLKKQAEACRNCMMNRKRAARDDASKAAL

SEQ ID NO: 6668 - protein, 33 aa, synthetic construct
KYRFLCRILRKFCCKFWLHLKANLRARPALRRL

SEQ ID NO: 6669 - protein, 55 aa, synthetic construct
RLRFLKRFFKRYCPKLCKKWNIPPAHKLLYERALCAQCLARAMRLENKLKTPKLR

SEQ ID NO: 6670 - protein, 25 aa, synthetic construct
KLKLISRLYKLLRKECLKSQGCAKQ

SEQ ID NO: 6671 - protein, 43 aa, synthetic construct
RFKIIKKILRIFRRLFQLAKPRRARHAAGTLWLIARAYTKFVM

SEQ ID NO: 6672 - protein, 32 aa, synthetic construct
RLKWWSKYMRFFRKFPARCAAMRHTLKANLAL

SEQ ID NO: 6673 - protein, 33 aa, synthetic construct
KMRILRKWLKKLKKAMHAKFTRALQVYACLVSF

SEQ ID NO: 6674 - protein, 35 aa, synthetic construct
MWRLYRKMLKKLNNTIALQRRMRKLAKKAMGPPRL

SEQ ID NO: 6675 - protein, 43 aa, synthetic construct
LLRFLCKLFKRWCHKKDDKRNKAQGLAPGLLKDIMPAARRTTL

SEQ ID NO: 6676 - protein, 20 aa, synthetic construct
KYKLLKRMYRRLHQKLPNHA

SEQ ID NO: 6677 - protein, 29 aa, synthetic construct
FMRLLSRILRKLRKSYPSHMKLLQKEKAP

SEQ ID NO: 6678 - protein, 24 aa, synthetic construct
RLRFMKKLFKFLSKLLTTNKHTAR

SEQ ID NO: 6679 - protein, 25 aa, synthetic construct
YLKFFRRFLRLYRQHDKLMLAFARD

SEQ ID NO: 6680 - protein, 67 aa, synthetic construct
KLRFIKRFYKLLKRGWTAFVARKLRAEARHNKRTLALWRALTYKLEVDAARCRDEAECLNAVFAIRP

SEQ ID NO: 6681 - protein, 40 aa, synthetic construct
MIRWLKKYLRWLSKSKARALGRAHAYDEFAVARKYLRLQD

SEQ ID NO: 6682 - protein, 54 aa, synthetic construct
RFRILKKLLKKLPKRFEPEHERALMKYTSDILQRKGKKRELALHMAPRAPRVHA

SEQ ID NO: 6683 - protein, 76 aa, synthetic construct
KLKFMRRYYKKYRKAAQRVALCRARALHKKPAKGSESRSGLLKKAAPPQGTTRVPIALTRLRRPFDQRLLFMGFLL

SEQ ID NO: 6684 - protein, 27 aa, synthetic construct
RYKMLRRYLRMLRPSLYMKALRLAQVL

SEQ ID NO: 6685 - protein, 23 aa, synthetic construct
KLKLMCRWLKMLRSLLQLEDSGK

SEQ ID NO: 6686 - protein, 55 aa, synthetic construct
MLRWWPRFIRKLPKRTPKRLEALLWRLLADLCQRAIGRDAKALNMLWCSKVVKKL

SEQ ID NO: 6687 - protein, 41 aa, synthetic construct
FLKLIRRYFRRFKRHSNSNKAREAAYFAKKALKGAKILAPM

SEQ ID NO: 6688 - protein, 54 aa, synthetic construct
KLKLFKKLLRYFQKLWMYLFRRAARLWCAELACGALWLFLLKARLMQKIKRKHA

SEQ ID NO: 6689 - protein, 23 aa, synthetic construct
KFRYYKRFLKFMNKELAAAAVNL

SEQ ID NO: 6690 - protein, 43 aa, synthetic construct
LFKLLNKWIKKFRKKMLERDKKPRMPTTLKNLAHVKLAFWRAY

SEQ ID NO: 6691 - protein, 91 aa, synthetic construct
RLRFFQRWMRRYQKVAWYKAACKELAAAVGKAKARCPKKLARWAKFKSWQPLMIKAYRLPARRKKRRFAIQSRAWWLVKGMLSRRCKQLLR

SEQ ID NO: 6692 - protein, 33 aa, synthetic construct
KLKFMKRILRKMHNLMTLNADLKKKKLNKAFHD

SEQ ID NO: 6693 - protein, 47 aa, synthetic construct
RLKLLRRFLRKFKNLAMERHKCNRKRQLWRHLSFAASCLGKARWAAR

SEQ ID NO: 6694 - protein, 20 aa, synthetic construct
RLKLLPKYLKMMKKDIHMAK

SEQ ID NO: 6695 - protein, 28 aa, synthetic construct
RLKYFRRLWRYLKRKLYLDWFWAARCAL

SEQ ID NO: 6696 - protein, 21 aa, synthetic construct
WLRLLQKMYRMINTKLLRRSA

SEQ ID NO: 6697 - protein, 21 aa, synthetic construct
MFRLFKRILRLLRHRQLASRD

SEQ ID NO: 6698 - protein, 27 aa, synthetic construct
FYKLFKRLLKWYTKAAARRGKANAAYV

SEQ ID NO: 6699 - protein, 87 aa, synthetic construct
KLRFIKRLFRKFPHLVARRKNTRKLETASLLLPNMKYREDLIFYKLRQGGKAAKAKDLITAFKSRNAALACKTKQHIDALAPAVLRL

SEQ ID NO: 6700 - protein, 30 aa, synthetic construct
LMRLLRRYLKMWRSAMLWAKTAHKQVEAPL

SEQ ID NO: 6701 - protein, 29 aa, synthetic construct
KWRLLHKMWRRFRKAKLFALPTLVARFNR

SEQ ID NO: 6702 - protein, 25 aa, synthetic construct
IYKWLSRYLRRFPTPKLKAAANADK

SEQ ID NO: 6703 - protein, 41 aa, synthetic construct
MYRLIRKLLRLFPKALKFLMTLYLKKDKRPRHKDERARCQY

SEQ ID NO: 6704 - protein, 23 aa, synthetic construct
IWRYLPRLYRKWRKKLSLMPLLS

SEQ ID NO: 6705 - protein, 57 aa, synthetic construct
KLRLLRRMWRRMRRSALAQRRKWELANWTLCSRKWDLKNRWWASLWRQHKKDAAHVL

SEQ ID NO: 6706 - protein, 29 aa, synthetic construct
RMRLLQRLWKRYRKALDQKYHLLRHYMLL

SEQ ID NO: 6707 - protein, 100 aa, synthetic construct
LIRLWRKIIKIFKPHQKLKYGAKLLLMTTATYRTKPARALTSFADKLFLYFLQRKFEYAAAKRGRRPRCAANLCKLKRTRKNEPQAAKDKLKYLGLLNNY

SEQ ID NO: 6708 - protein, 43 aa, synthetic construct
RLKLYKKFFRKFTRQDRKQLNHLLLLAFKRAMMPLARAWSAIK

SEQ ID NO: 6709 - protein, 30 aa, synthetic construct
KLRILSRLWRKLSRLALKIKIGFIAKELAA

SEQ ID NO: 6710 - protein, 65 aa, synthetic construct
KLRMFRRIMKFLKRMLALAQHFKFNAARRAVCRVLKCLRLLAMKQYLPRKCHLDRIWNRKAMYHK

SEQ ID NO: 6711 - protein, 38 aa, synthetic construct
KLKFLRKLYRLLCPLSISYRPHKRLRANAGHLARCCLH

SEQ ID NO: 6712 - protein, 75 aa, synthetic construct
YFKLYKRLFRLYRRMACPKLVAKLPWLAMKMNQSGRKTARSHAQDAADCRTLRFGILKCLRLRRCRLVLKRPRLR

SEQ ID NO: 6713 - protein, 33 aa, synthetic construct
RFKFLKKYMKRLNHALNCQQKARLKYSHAAILL

SEQ ID NO: 6714 - protein, 32 aa, synthetic construct
KFRLLQRMLKKLRQFAAKWFKKTECQLQAAQK

SEQ ID NO: 6715 - protein, 85 aa, synthetic construct
KLKFLRKILRKIHKGNWNRWRKARGKLAYRLKKWCFVRPRCRASAKRCKWATLRSLIYDKLDCTNALCLCTKSNKLKAAQLPGAM

SEQ ID NO: 6716 - protein, 26 aa, synthetic construct
FMKLWQKYLKRLRQAWLRHLKTGLFR

SEQ ID NO: 6717 - protein, 74 aa, synthetic construct
RMRLIRRLLRKYCNTKAGAVKMALALHFKMRARTSNKKELCGARDKRKNLQHIAGYAALLHKPLKHCAAICAPR

SEQ ID NO: 6718 - protein, 88 aa, synthetic construct
KLRWMKKFYRLLRQRWRCGCKRKKCSDKDRTRSDWRLERLKMDALARRLMLICWPMKKLADDRFARAALKKKWPASSAHRALQLMKLE

SEQ ID NO: 6719 - protein, 23 aa, synthetic construct
KIRYYRKWLKLFNKAHLRARIAA

SEQ ID NO: 6720 - protein, 56 aa, synthetic construct
KLRFLRKWIRLWQKQAKDDHALHRAPRLMKKKYRNLKVAPFRRWKLEAKKALAFMT

SEQ ID NO: 6721 - protein, 29 aa, synthetic construct
LWKMLKKMLRYFSRERHKARCAATFLPRH

SEQ ID NO: 6722 - protein, 22 aa, synthetic construct
LMRFLTRFLRKLRRVACAAWIS

SEQ ID NO: 6723 - protein, 61 aa, synthetic construct
YFKLYHRMMKKLCRAALYKCLCLEKKYTLSGELQLLLMARAEKVRACRALLRKKNAQRDRD

SEQ ID NO: 6724 - protein, 55 aa, synthetic construct
FLKLFKKWLKKLRRWARLDASAQNVQCARLQLHHWKARRQAAVKAELKELWSQWI

SEQ ID NO: 6725 - protein, 34 aa, synthetic construct
LFRWLRKFIKRLKKRLWLALLAKDKTIFLYMPWK

SEQ ID NO: 6726 - protein, 32 aa, synthetic construct
FWRLIHKMLRRFKRLRKASADELNKHASLRRV

SEQ ID NO: 6727 - protein, 27 aa, synthetic construct
RMKMLHKYFKWMQRSLGKATYRAALLR

SEQ ID NO: 6728 - protein, 20 aa, synthetic construct
YLRLLQRFLKKINRPYALAR

SEQ ID NO: 6729 - protein, 20 aa, synthetic construct
RFKLMSKYWRLYQRLKRLAY

SEQ ID NO: 6730 - protein, 54 aa, synthetic construct
LIRFWKRLMRIMRRKANFAACEKLKYNRCIKQRKHNAVAERACLKALVWVRRLL

SEQ ID NO: 6731 - protein, 25 aa, synthetic construct
FLRILRKFLRKMCKTARAWKALPAI

SEQ ID NO: 6732 - protein, 34 aa, synthetic construct
RWKYMCRWFRKLTPRCNIALLCAERRAMANLRLL

SEQ ID NO: 6733 - protein, 31 aa, synthetic construct
YMKLYKRFYRKLKCAAAIRRYRKKDLGDYLA

SEQ ID NO: 6734 - protein, 40 aa, synthetic construct
KLRWLKKLMKRLKKNCVRLKKPHCCLEMFAACSRKFASAP

SEQ ID NO: 6735 - protein, 91 aa, synthetic construct
RMKFMSRLFRRMRQKRPRLAVRKMRARALVDHLAQKSCKRMALKKRKGKVRWLAECDVARSVAAKADSRLVYDKAWVAALALTCLTIIKFD

SEQ ID NO: 6736 - protein, 28 aa, synthetic construct
RFRLMPRLLRRIRRRCGTLMLRQSPAAL

SEQ ID NO: 6737 - protein, 91 aa, synthetic construct
MLRIFKRLFKKYKQRRPEACKKKMLRAAFPNAALYITKKFAKRLKDPMRPKKAAGSQERAKGAKTLPFRRMHLLLRSLYKSAGWPRSLWAS

SEQ ID NO: 6738 - protein, 50 aa, synthetic construct
RLKLFRKILKKFRRQCCRSHQKNADAISKRFCLAHADAWKAVKKLGKTAF

SEQ ID NO: 6739 - protein, 78 aa, synthetic construct
RLRFLRRLFKFYKKALNAISKWRVFDYVAAKLRKRLAGTKQDALHRSRWVSVNIRIALDAYKLFAQRKRRMVRYAIVR

SEQ ID NO: 6740 - protein, 73 aa, synthetic construct
KLRIFRRLLKRMPKGYTRGAERHAHKAKPAGAAQEPRKSRTRFNGRRCPAACLDILAKRAWRLQRRFRKKWAA

SEQ ID NO: 6741 - protein, 36 aa, synthetic construct
LFKLFHRYWRLWKTAALGDKLRTQERAVAYRPLKKQ

SEQ ID NO: 6742 - protein, 29 aa, synthetic construct
RLKMWCRWFRRLRKTGLPAVRPDRLPAAQ

SEQ ID NO: 6743 - protein, 45 aa, synthetic construct
KIKMLKRFMKRLKSALADLRHKLDKKLLLPKNLAKKRMVAVLAQA

SEQ ID NO: 6744 - protein, 62 aa, synthetic construct
LFKLYKKLLRFWRKPAYFERKEANLAGSAIAKLAKVIWATWRYKLRRKLAPKCAIMKTAVER

SEQ ID NO: 6745 - protein, 35 aa, synthetic construct
KIRWYKKWLRRLRPAHARWLCNMCLAKFLLLEREW

SEQ ID NO: 6746 - protein, 47 aa, synthetic construct
IIKWFNKLLKRWHNPLWNPINREKNLKEDALSRRARAALGLRRRRLA

SEQ ID NO: 6747 - protein, 53 aa, synthetic construct
LFRFLRKLLKFLKRSLRRNVYLIRLPYMKENFFKQFLAIKRALADTMKYSRKK

SEQ ID NO: 6748 - protein, 62 aa, synthetic construct
KLRMMKRFLRMLRKNRWAMRLWPFAVLLLLWMLKAKRGAALRRRAWWEHWFLHAHPFNGRRL

SEQ ID NO: 6749 - protein, 35 aa, synthetic construct
RLRFWKRMLKKWQRPFRRAKSFPALAIAGLLITKP

SEQ ID NO: 6750 - protein, 35 aa, synthetic construct
LLRLYHRLFKKWRKTQLLQFKHKMLPKRAINWRLL

SEQ ID NO: 6751 - protein, 22 aa, synthetic construct
KYRFLNKLLRKLSKKVKAYAVA

SEQ ID NO: 6752 - protein, 80 aa, synthetic construct
LLKYIRRYYRYLRKHDLRKTQMAAAFLPRKLAAKMDLVCATDLWWSSLRVNVLAAMAALLRKKHLERKSKKLNTFLARPM

SEQ ID NO: 6753 - protein, 37 aa, synthetic construct
RMRLFKRMIRKLTKWSKHHKAGGALLLDKLILAHIKQ

SEQ ID NO: 6754 - protein, 46 aa, synthetic construct
FIRLWRKFMRKYRQAKMNTLERKLLAIRILAVKNVYAYLAMSLKAR

SEQ ID NO: 6755 - protein, 26 aa, synthetic construct
FWKLLRRFFRWLNKSHDKRAVKILLA

SEQ ID NO: 6756 - protein, 47 aa, synthetic construct
FLKLIKRFIKRLRRTCPIIRRRLRHEKLYCALKRAWAGHSHANLAAT

SEQ ID NO: 6757 - protein, 55 aa, synthetic construct
LLKLFPKWMRLMKSATAAKRKPGGRPLRLRKQVWGALRASAMALQLKSQMKKGSA

SEQ ID NO: 6758 - protein, 41 aa, synthetic construct
KLKILKRFWRLFNQRSQARKFDEWKLMTRAWILCARLRIKL

SEQ ID NO: 6759 - protein, 67 aa, synthetic construct
KIKIIRRMLRKWNKMPYGQRSGRGKYWRDRAAAARKFALWYDFLLIQKAKALKARPKQPWLKQAKLP

SEQ ID NO: 6760 - protein, 52 aa, synthetic construct
IYRMFKRLFKRLRHYKGMYKAHLALRRRYGPLEAMFDLLLATRRYGGLALRL

SEQ ID NO: 6761 - protein, 20 aa, synthetic construct
YLRLICRLIKKLTCLWDLKR

SEQ ID NO: 6762 - protein, 68 aa, synthetic construct
RYRLMNKFWRILRRLFRQAMEAKLETAAPHGVWEWKRHLKKRKMRLRCAAADKLYKQRKRACILAIAK

SEQ ID NO: 6763 - protein, 36 aa, synthetic construct
LWRFLNRWIRLFRNLRIRDEHPKPLMASKVARKAAA

SEQ ID NO: 6764 - protein, 40 aa, synthetic construct
YFKFWKKFWRLLRKGDGAMWKLRKRLANLATARRIAMQMP

SEQ ID NO: 6765 - protein, 23 aa, synthetic construct
LYRLLRKFLKLFPRHYVTLAKWT

SEQ ID NO: 6766 - protein, 90 aa, synthetic construct
RYKYMQKWLKKWKKAGILLKLHLIALFQNRKAARKDQLKLAAKLRGWTKRMLRKRKVGLQHGWAVKVLKLAVIANREFSAEKKVYLKNCK

SEQ ID NO: 6767 - protein, 40 aa, synthetic construct
YIKLLRRLIKKMPKLYFRKTEYLNMAWNSNAARLRLRQRS

SEQ ID NO: 6768 - protein, 20 aa, synthetic construct
LFKLYRRILKMFQRLEKARA

SEQ ID NO: 6769 - protein, 33 aa, synthetic construct
IIKLLRKLWRKLRHLLAAKLRGKKLMQTRFRRE

SEQ ID NO: 6770 - protein, 50 aa, synthetic construct
KFRFLNKFFKKFRCRLLYKMRFLLNRIALRKIRDLKLAKKLLYRPSHTRL

SEQ ID NO: 6771 - protein, 48 aa, synthetic construct
KFKFLSRWYRKMKRALAEFFLALHSTLMRRSFRTKLEDAKRDGAKAIL

SEQ ID NO: 6772 - protein, 32 aa, synthetic construct
MFRLIRRLLKKLRSTYRLLKKCALHEWAVMML

SEQ ID NO: 6773 - protein, 46 aa, synthetic construct
KIKWLRKLLRYITKCIARFLLLAMYLLKQAKTKKPIKVGRMALHQK

SEQ ID NO: 6774 - protein, 61 aa, synthetic construct
WIKFLRRLLRLMKSASRVKKHGRAKPAVLLGAQAIGVAFWRIQVIDCRKKKRLIVLLKAAN

SEQ ID NO: 6775 - protein, 54 aa, synthetic construct
KLKIIKRMLKLINRRRCEIEEARFRRAAHLRFCRLHRAVLRHTMLALREATHKK

SEQ ID NO: 6776 - protein, 26 aa, synthetic construct
RLRIFHKFIRLFCRLATRKLCELLLK

SEQ ID NO: 6777 - protein, 50 aa, synthetic construct
KLKILSKLLKILNKTKKLDYKLLLAIMARRKKKVFKKVWIPIKKALKECG

SEQ ID NO: 6778 - protein, 61 aa, synthetic construct
IMKLMRKFWKRYRKLTCLLFTKTERMHLAERKHARAILLAPYKAAHLLKHQAELDGPKKAA

SEQ ID NO: 6779 - protein, 23 aa, synthetic construct
KFKILSKFLRMYNRLGRLKLEAR

SEQ ID NO: 6780 - protein, 46 aa, synthetic construct
MMRMMKRLIRRLCRYKVRTHAFVASRHADAADAPIKWRKRLRTLKL

SEQ ID NO: 6781 - protein, 40 aa, synthetic construct
KLKIWKRLFRIIRSHLAKNHAFMHKAIANVTHAKLRRKML

SEQ ID NO: 6782 - protein, 70 aa, synthetic construct
RLKYFKKLWKFIKKKFAREMNAAALSVNQLLKQLHRTAAAKAWRNRALCKIKWCLRKRWLYAQHRAWGGP

SEQ ID NO: 6783 - protein, 57 aa, synthetic construct
KIKFWRRFLKRLKNKTHMAALLPANLAASFALLASMRCLCHKKCMRAKYKSAFAEAV

SEQ ID NO: 6784 - protein, 43 aa, synthetic construct
MFRMMCKWLRFWHKKYKLRHALLAHRHLFLWCARKFARKDKCK

SEQ ID NO: 6785 - protein, 31 aa, synthetic construct
RWRIWCKLLKKLKRNAARKKASAGDCFMADI

SEQ ID NO: 6786 - protein, 69 aa, synthetic construct
RLKLFTKYMKRFRKPRHMLRVLHLLKADLHWKRADWDLMTLRCLMKKYRRADIGNARVNHLCRLARRCS

SEQ ID NO: 6787 - protein, 50 aa, synthetic construct
RIKWYNRLWRYMKTKKELYARMRLRLLLLSHKLDRTKCLRAQIEAQKLNR

SEQ ID NO: 6788 - protein, 39 aa, synthetic construct
KFRIMRKLYRLYRKKWWFRGFRLALPHLATYKQAHANAK

SEQ ID NO: 6789 - protein, 28 aa, synthetic construct
RLRMWPKLLKLLPRAWNAAVKGLHRQIH

SEQ ID NO: 6790 - protein, 64 aa, synthetic construct
RLKLYKRILRKLNRAKLKDWRACRKDVGSYLDSFALAASSLRLAVLSKRWRYAPTSHLCFKSAK

SEQ ID NO: 6791 - protein, 22 aa, synthetic construct
RLRFLKRWLRRWCRCAVRAKLA

SEQ ID NO: 6792 - protein, 40 aa, synthetic construct
KLRMMKKLFRMLTQLKLRDFALMRKKWCIKEKLCLELYQL

SEQ ID NO: 6793 - protein, 45 aa, synthetic construct
KLRLLPKMFRKLRSALWRRTSDMMAILGRARAKNSRRSAKAKRGE

SEQ ID NO: 6794 - protein, 37 aa, synthetic construct
LLRFLRRWWKWMKRYAALSALHKRPFMTRHFIARHLL

SEQ ID NO: 6795 - protein, 73 aa, synthetic construct
RWKLWCRLMKRMKRAWQQHALTMKLRKIRHRWIMRLRARHLRARPRAKVALYAYWLAALKIMFFQFRLHAQRC

SEQ ID NO: 6796 - protein, 39 aa, synthetic construct
KYRLWHRLWRFLPPSLAAKARRALDFMNKKALRRAGTRA

SEQ ID NO: 6797 - protein, 46 aa, synthetic construct
KWRWLTKLLRLLKKTALASARGLRTPRMEPVHLYQAYHKRCAMKML

SEQ ID NO: 6798 - protein, 22 aa, synthetic construct
KYKWWKRLLRFLRPARAPCAKF

SEQ ID NO: 6799 - protein, 36 aa, synthetic construct
RLRFFKKFYKKFPRRLALAALCDRPFKLFRGWDHHL

SEQ ID NO: 6800 - protein, 48 aa, synthetic construct
RWRWYPRLYKRLKRHHKCGVKLAYIFMACPKLLWDKLLNKKAQLLLYL

SEQ ID NO: 6801 - protein, 20 aa, synthetic construct
RLKFLKRWLRRLKCFLHFNI

SEQ ID NO: 6802 - protein, 65 aa, synthetic construct
RYRLLQKIFRLWNRSVKLRCDKTNRCKLYCAALLTKLALKANLSKKALRYKADLKQRNEKHFAFD

SEQ ID NO: 6803 - protein, 43 aa, synthetic construct
MLRWLKRWMRLFKRAIKNQQSEAHAMALAAMLKINAKLKNHPL

SEQ ID NO: 6804 - protein, 38 aa, synthetic construct
KFRWLKRLLRLLPRAMREDMAKVQRPHMPRALWKDMMR

SEQ ID NO: 6805 - protein, 55 aa, synthetic construct
KLRMLPKWWRRYCQALLSLKGLMRPADALGCRAAKMKGMILRRPRYDLAKKCWAR

SEQ ID NO: 6806 - protein, 44 aa, synthetic construct
KMKMLRKFFRFYHSKDGNMRAMLRAALFLLLRIAMRYKQKLTRL

SEQ ID NO: 6807 - protein, 23 aa, synthetic construct
LLKYFCKFLKKLKKAHVLKRADL

SEQ ID NO: 6808 - protein, 20 aa, synthetic construct
KLKLFPKLFRFMQRLLCFKQ

SEQ ID NO: 6809 - protein, 81 aa, synthetic construct
RIKFLTKLLKYLTKNRHNLARRLKQRDALLWLNDVLTFPAPWRMKRKLLQKYLLDAKGRDLNRLPVCAAVSHKRRSLGNRA

SEQ ID NO: 6810 - protein, 63 aa, synthetic construct
KLRMIKRLLKMLPSLANINHLRQLVQCEKRKRDSKLAAKARLNRYRAREKMIAVLRRRDAWKA

SEQ ID NO: 6811 - protein, 67 aa, synthetic construct
WFRLLRKFWKILRRWLKKEKADQRPMKAEVLAMARNKVQKPQLICAALWKFSRNLAAKKLGRMFSAN

SEQ ID NO: 6812 - protein, 53 aa, synthetic construct
MWKFMRKLIRKIKRAKKHQMRCLLLGYMMAKRGTILRALKTGRASKRADAAYM

SEQ ID NO: 6813 - protein, 23 aa, synthetic construct
WIRFLKKLIKRFRRLAKWVANEA

SEQ ID NO: 6814 - protein, 59 aa, synthetic construct
ILRLFKKLWRRFRRAPWIASQLAIEMRLAKKLGATTVRHWGASAKTWRWKRLLYAFAWL

SEQ ID NO: 6815 - protein, 45 aa, synthetic construct
RWKFLCKFWKFFRKRFPVAAILAAKLQSMKTLRHKYAKKKSEAAK

SEQ ID NO: 6816 - protein, 30 aa, synthetic construct
RFRLLKKLFRKLKHAKPLFAFATCGAKAVS

SEQ ID NO: 6817 - protein, 51 aa, synthetic construct
LMRFMRRMWKLLCKEAIALKHYAAQKKRRAYAAKAYISALTELLRGYARRA

SEQ ID NO: 6818 - protein, 36 aa, synthetic construct
FFKFLRRLLRKLRTCLVITMGLLRRTKLYRVLTLRA

SEQ ID NO: 6819 - protein, 52 aa, synthetic construct
YLKYLRKYMRLLRKLKNKKDKAIKQAWIHLEKALKWRGPNRFIFLYFKPATL

SEQ ID NO: 6820 - protein, 32 aa, synthetic construct
KIRLFRKFLRYLHKANKLPAIGKLSGRVKLSK

SEQ ID NO: 6821 - protein, 40 aa, synthetic construct
RLRIICKFFRKLKKKAKAPVCCRLANLALSYGLFWLRTNI

SEQ ID NO: 6822 - protein, 38 aa, synthetic construct
RMRYLHKLLRYFKCAEWHLAALFCKCLRIELRMFKWAR

SEQ ID NO: 6823 - protein, 43 aa, synthetic construct
KYKYLPRFLRIYTTKTNYLKRAGIEWKRFLRAAHTLNKAALKA

SEQ ID NO: 6824 - protein, 21 aa, synthetic construct
FFKLLKRLYKLLQRRAPLYRV

SEQ ID NO: 6825 - protein, 45 aa, synthetic construct
RMRFYKRLLRLFTRLLLLRMHMVKARAQKVGMNQRLANEAKYGQR

SEQ ID NO: 6826 - protein, 31 aa, synthetic construct
MMKILNRLLKKWRRLFNAAKYRLRTYALFRE

SEQ ID NO: 6827 - protein, 21 aa, synthetic construct
FLKLFTKILRRLNRLLQRTMD

SEQ ID NO: 6828 - protein, 20 aa, synthetic construct
KLRLLRRLLKFMKCRSAHFQ

SEQ ID NO: 6829 - protein, 30 aa, synthetic construct
FLRLLRRLWRKMRPALRPFRQALFRATCIF

SEQ ID NO: 6830 - protein, 23 aa, synthetic construct
FFRLLKKYLKKITKFADLLGRLT

SEQ ID NO: 6831 - protein, 26 aa, synthetic construct
KIRILRKLLRKLKNFNATAWAKWKKL

SEQ ID NO: 6832 - protein, 66 aa, synthetic construct
LYRFMKKLWKLYHKLDRRTCMAGRRRARLLAYIEANKLAVLLYPQLDATLEKQKRKKKMRYTRHTF

SEQ ID NO: 6833 - protein, 29 aa, synthetic construct
YIKILKRYLRWLRRDLLVCWKAPARNRAS

SEQ ID NO: 6834 - protein, 30 aa, synthetic construct
KLKLFRRLLKKWTHKLKHRATIFLSAIRLK

SEQ ID NO: 6835 - protein, 44 aa, synthetic construct
MIRYFKKLIKRITRQKYGCERARAIIKKYLTRAAALERCARLLN

SEQ ID NO: 6836 - protein, 29 aa, synthetic construct
LLKLMRKILKLFHKTASKQRCILDAILWP

SEQ ID NO: 6837 - protein, 34 aa, synthetic construct
RWKFFRRFYRLWRKKFWLLVKPKALEKLDAILEG

SEQ ID NO: 6838 - protein, 26 aa, synthetic construct
LLKMFQKLFRRLSKIRRSEKCYAAAW

SEQ ID NO: 6839 - protein, 38 aa, synthetic construct
ILKFFCRFLRKMQKKDLLFRRLSFWKETYLKLLARFLN

SEQ ID NO: 6840 - protein, 52 aa, synthetic construct
RLKFMRRILKRFKCIEAGILVQAARKVSKAAALRREGWQMLGLKIKSRAKLQ

SEQ ID NO: 6841 - protein, 21 aa, synthetic construct
RMKFLRRFFKRWTKQALLHLL

SEQ ID NO: 6842 - protein, 81 aa, synthetic construct
RLRFFQRMFKRIKKWKAPKEGQAPILCLLRAEAWTAYALRLARGDSGRLKKNRAKQNCLTHKCEAVKAQKKDKGFRRRAKL

SEQ ID NO: 6843 - protein, 32 aa, synthetic construct
KLRLIRRLIKLFKKHLDLTLAFKLWLKKALTH

SEQ ID NO: 6844 - protein, 26 aa, synthetic construct
KLRLLSRMIRRLKKLFRAREPVANTQ

SEQ ID NO: 6845 - protein, 70 aa, synthetic construct
KFRLFRRYMKIYQRKDLRAKSLKAGVAAAYKKRLVLRKGAWFKIFAPWRLAIKLRQFDYAARAFFMLCLI

SEQ ID NO: 6846 - protein, 38 aa, synthetic construct
MLRFFSKLLKRLRPEMLQMLAKKLLYSQNRLSRRTSLL

SEQ ID NO: 6847 - protein, 83 aa, synthetic construct
MFKIIKKYWKWMKSAKRCPCDDALRHDLIKAKAQKTRQGWCPAKKVKRLLITFVRELEKRAYLRKALLRKFFQALLLASELAK

SEQ ID NO: 6848 - protein, 58 aa, synthetic construct
MWKLLHKLFRRFSKHWTADVRKKRGLADEYFKLRAYKRVRLRKAKGLCEAAKAVSDIN

SEQ ID NO: 6849 - protein, 29 aa, synthetic construct
LLRIFKKLYKFIRCTSYLPAKRWKATKQA

SEQ ID NO: 6850 - protein, 49 aa, synthetic construct
FIRLIPKIYKYLHKFGYWTWALLARPRDWRLEALLLTKACLLKADRKVK

SEQ ID NO: 6851 - protein, 39 aa, synthetic construct
LLKWLRKFLRKWKCAADAANFRNYKAKWKKLDSNRVKNM

SEQ ID NO: 6852 - protein, 36 aa, synthetic construct
KWRFLTKLYKKFSRRPKLLPRVNALDKSVAIQKALS

SEQ ID NO: 6853 - protein, 62 aa, synthetic construct
LLRWFRRFWKFLPCRTDYKRRVGRLLFLYKKLVREKERAPRLLYKGLILGLQILALCRFSKL

SEQ ID NO: 6854 - protein, 40 aa, synthetic construct
FIKLLRKLMRRYPNWRWAAAQYRLKHWFRWARLHSLKREE

SEQ ID NO: 6855 - protein, 42 aa, synthetic construct
WLKWLTRLLRRLTNLMKLKAKNCKGLYGTKKFHNLRASLELG

SEQ ID NO: 6856 - protein, 20 aa, synthetic construct
LWRYMQRYWKLLRCWRLKLR

SEQ ID NO: 6857 - protein, 80 aa, synthetic construct
WIKFWKRILRIYCKEKADHKMPFKSVRLPAASKANLMRALLTWKQMVKRAAALLLRRARDRNKLAKQTADYKLKRVRVAI

SEQ ID NO: 6858 - protein, 58 aa, synthetic construct
YMRFFQRIFRMLKTKFRLHKTLKARKVMVAHIRRAQARKLACFLAALDEELLLARGII

SEQ ID NO: 6859 - protein, 42 aa, synthetic construct
FFRLLRKFLRRWCRKRDKKLARLVCAAKRQDNAQAAMSWHLN

SEQ ID NO: 6860 - protein, 21 aa, synthetic construct
KLRLLCKLFRIFKNHGLQRAA

SEQ ID NO: 6861 - protein, 84 aa, synthetic construct
ILKWWRRLLKRFKKARLRTKGWVLYLKFAYDPKLKRNRRFKAWWLYSTEKKCATAAAETACKNTMRRGRNGDLVKELQPAARLL

SEQ ID NO: 6862 - protein, 38 aa, synthetic construct
RLRYIRRFFRWIRKRNGRTCLNLALAICHDAKIAKLLM

SEQ ID NO: 6863 - protein, 21 aa, synthetic construct
LLRLMSKYMKKLRRGNYLCLS

SEQ ID NO: 6864 - protein, 78 aa, synthetic construct
WLKLLKRWYRKFRTAATRILELALAGHPQKFARLLKRTAKKIRAHKKLTTRLRSLLKWHATYLYWHAAMCVGEAPFRT

SEQ ID NO: 6865 - protein, 20 aa, synthetic construct
LLKILTKYFKRICRLADAKL

SEQ ID NO: 6866 - protein, 30 aa, synthetic construct
RFKLLCKFYKRWRTPLRFRYALQFSGARKL

SEQ ID NO: 6867 - protein, 53 aa, synthetic construct
RLRMWRKLFRMWRRVAQLAKNRAAAAYKAKLKVAMNYAFRYNSARRWLAMLFW

SEQ ID NO: 6868 - protein, 39 aa, synthetic construct
KFRLLRRLLRMFSCIKRNLELDWAIARKKCNAWKRDLKY

SEQ ID NO: 6869 - protein, 53 aa, synthetic construct
RFRFLPKFLKKLQKQFRALNLTARRKMETAGKKMLLNRYKLAAAKTAALFLAQ

SEQ ID NO: 6870 - protein, 61 aa, synthetic construct
RLKWFCKFLRRFKRRRRRQRHLTPARIVLKAVAAARFKRQKLKLLKPHTAADPAWGVPFGV

SEQ ID NO: 6871 - protein, 37 aa, synthetic construct
LLRLLKKMLKLLRHVTVRKKARLPNIPRDMKMFALLM

SEQ ID NO: 6872 - protein, 32 aa, synthetic construct
FFKLLKRYMRKLRQREEQKLMLLATCLVRKAR

SEQ ID NO: 6873 - protein, 60 aa, synthetic construct
RYKWIHRMLKRYPKNKVLAKAQSRGAFRDLVALAARATRLPKAQLKLKRARWFAFAWMLA

SEQ ID NO: 6874 - protein, 59 aa, synthetic construct
KFRLMKKIWKFYTHAALIVQRILKAKQKRRRQYRAALVLRAKKGLYAKTQALMMDPALG

SEQ ID NO: 6875 - protein, 29 aa, synthetic construct
ILKIMKKLLKYWKRSISHANAKARMLEMA

SEQ ID NO: 6876 - protein, 38 aa, synthetic construct
MIKLYRKLYKLWKPEMKGLFRTKGLHSKWNALARRRLS

SEQ ID NO: 6877 - protein, 42 aa, synthetic construct
KMRWLNKLLRLWRHLTIYILAHWANLLAKCKLKLLKRYGRER

SEQ ID NO: 6878 - protein, 45 aa, synthetic construct
FFKYYRKLFRWFSKGAAGKRRSNALSDRAAKPACKASRYLRLKRS

SEQ ID NO: 6879 - protein, 58 aa, synthetic construct
RLKWLKKFLKMLKHRRLKFLNRLAPMLSNPYKMPACRYTARRMKIQALLCDAKNAENK

SEQ ID NO: 6880 - protein, 27 aa, synthetic construct
YLRYFKKLFRRINKQLLKAAACMQKQV

SEQ ID NO: 6881 - protein, 43 aa, synthetic construct
RLRLLRRLFKKFTCYLLRWGHKFRVSFKCRAAKARNMRLKADF

SEQ ID NO: 6882 - protein, 30 aa, synthetic construct
RFKYYTRLLRWFKKLVKLRGAELLTAHARG

SEQ ID NO: 6883 - protein, 38 aa, synthetic construct
IFRMIRRYLRYLKRPKLLRRKNSLRLLMLLATKCFAQC

SEQ ID NO: 6884 - protein, 58 aa, synthetic construct
MWKLLPKILRRLKHFMKLHKELRKRRKMALLKRTARRIWVGNTHADRMQCSNRHALLK

SEQ ID NO: 6885 - protein, 35 aa, synthetic construct
FLKFIRRWLKLFNPVAARKLKLKRDWKWMQLNKAK

SEQ ID NO: 6886 - protein, 100 aa, synthetic construct
RMKMWKKLLRKLNKLLLYLQFKRHAQAALPLKNRRARFNSLDLFKNRTRSCKVLAKNDKLKLKDHILRRDLLLKDRDTCNMKRFALKYIFLGDNFASRRG

SEQ ID NO: 6887 - protein, 27 aa, synthetic construct
KLKLWRRYLKRMTNAALKANLILFKTK

SEQ ID NO: 6888 - protein, 24 aa, synthetic construct
WMKYLRKLLKLFCSCARIHTRARA

SEQ ID NO: 6889 - protein, 73 aa, synthetic construct
RIKMFRRYLKRYKNGTRAPDWDLRASASLLALKRRKSLGVHKGAAKRCLRKGFPLHSKLAAYKWQRLRLALPN

SEQ ID NO: 6890 - protein, 46 aa, synthetic construct
LFKMLRKLFRKFRKFAMKRPIKLALKLFKGAGIQTLLIVKMKIRLN

SEQ ID NO: 6891 - protein, 47 aa, synthetic construct
MYKLFKRFLKRYKTTTAYLVAYRKRARARANVRAEKQKGNLELVFLA

SEQ ID NO: 6892 - protein, 52 aa, synthetic construct
MFKMLRRFMKMIQQLRALWIKYKHKKHASCLNALWELKALAHALRKKIYDAK

SEQ ID NO: 6893 - protein, 22 aa, synthetic construct
RLKFFRRLFRYLSSGDKLLLAR

SEQ ID NO: 6894 - protein, 38 aa, synthetic construct
KLKLWTKLLRMFRKVRLKAMKLCETKGFMAYMMKLASC

SEQ ID NO: 6895 - protein, 91 aa, synthetic construct
WFKFLTKFMKFLCHIPQALAAKFKAPLRMIKLVEALLARAKAYPTCRAAYRKLVLARDQCCRENTKQIFAKNMLKGLLRAATKGRLLRKAK

SEQ ID NO: 6896 - protein, 51 aa, synthetic construct
RYRLYKKLWRKMHPIRKKHFIALRALSLIHRECNSTLEALGKWKLFRAKLK

SEQ ID NO: 6897 - protein, 53 aa, synthetic construct
KLRFWKKLFKWMKTNQANVARALKGCWALDRKRMRRAWVARLALPWLLAEKRA

SEQ ID NO: 6898 - protein, 71 aa, synthetic construct
ILRWMRRMFRLIKKLKLLKTRDRLMSARFEDQDQKRRVARSLCGRVKRLLLQAWKRLRIILCRMLAKMASF

SEQ ID NO: 6899 - protein, 20 aa, synthetic construct
FLKLIKRFLKKYRPLHARNQ

SEQ ID NO: 6900 - protein, 65 aa, synthetic construct
MFRWFHRWFKKLPKAAKKRLSEADWRAHAMARHHQLLLLIYKQEAKRKAARMTKAMNGFLANLVL

SEQ ID NO: 6901 - protein, 81 aa, synthetic construct
RLKLLPRLLRLYQNKNWHVILLTDAKKQNQRNAACLITGSPKQMRRRFYACWHKILGRLARAKAKKQTNRFLAKLAKEAMK

SEQ ID NO: 6902 - protein, 29 aa, synthetic construct
KLRYFPRWLKKLHQCKCTRKREGSLLLAM

SEQ ID NO: 6903 - protein, 32 aa, synthetic construct
LWRILTRFYRRLRRLRDWRLKLASDSKAEYKN

SEQ ID NO: 6904 - protein, 29 aa, synthetic construct
RLRLFKRYFKKLHCLSTYDLRAWKCREAY

SEQ ID NO: 6905 - protein, 50 aa, synthetic construct
ILRMIKKLWRRIRRRKKHIAASAPLNGGKCCRAAVTKRKVLNMAARALRC

SEQ ID NO: 6906 - protein, 79 aa, synthetic construct
KFRFLKRFFKKLTRAAEIRKYAGAKIATRLALPARDLREQMKDHRVYNAVRFKMAKFWRRLGARKALFCWRKPRVRVLY

SEQ ID NO: 6907 - protein, 46 aa, synthetic construct
FFRLLKKLLKRLKRLRIRLYVPIRAKGRKRAGSLLKQERAGQAITL

SEQ ID NO: 6908 - protein, 26 aa, synthetic construct
KFRWWPKWYRMWRKASLAALKNKPLL

SEQ ID NO: 6909 - protein, 49 aa, synthetic construct
LFRFMRRYFKRLRSARLTRAEKVWLSKMRTIALAAKWAYDLCPAWKKMA

SEQ ID NO: 6910 - protein, 33 aa, synthetic construct
RIKLLRRLLRKIKCNLEGLLWARGRFSKYRHAK

SEQ ID NO: 6911 - protein, 31 aa, synthetic construct
KFKYLRKLYKRLSRRLLTIRATTGLLRARLA

SEQ ID NO: 6912 - protein, 73 aa, synthetic construct
KIKLMRKFIRYIRKKKAVGGPRRLRYKQCFKALLREPFYKCELDRIAKDKLAAARKRYAQMHKASKALEIQAA

SEQ ID NO: 6913 - protein, 30 aa, synthetic construct
LFKWWRRLMKRLKRAHMSGANKACLKTATL

SEQ ID NO: 6914 - protein, 47 aa, synthetic construct
MLRWLRRLMKRYRRSNWLRIDILLWRLKLLPQIPHLERRGARACKDK

SEQ ID NO: 6915 - protein, 40 aa, synthetic construct
KLKYLKRWLRKFKKRKALEALRCLGYLEQMLTAPKRQLGK

SEQ ID NO: 6916 - protein, 20 aa, synthetic construct
FLKFLRRILKRYKRAQLQIV

SEQ ID NO: 6917 - protein, 24 aa, synthetic construct
IMRILQRLLKKWKRLHKAARWRYA

SEQ ID NO: 6918 - protein, 22 aa, synthetic construct
KLRMLRKYMRLFSRKIKDAIAL

SEQ ID NO: 6919 - protein, 65 aa, synthetic construct
RLRWYSRMFKKYRHLLKEYRENKLARKFQTRKLLKNKKWWARCCLAAFKYKALHMGHMKKLNPLQ

SEQ ID NO: 6920 - protein, 30 aa, synthetic construct
RIKYMKRFFRLLRNALALTLAFKEKMHLAK

SEQ ID NO: 6921 - protein, 38 aa, synthetic construct
FMKLWHRLYKRLRQLKWLRTAPYLDCVDNLRLKNDLRR

SEQ ID NO: 6922 - protein, 57 aa, synthetic construct
FIKLMRRWLRRIKHKAKRNLLADPTLTAQKHWRHFQARANLRLRKSGLLAQTKAMRA

SEQ ID NO: 6923 - protein, 58 aa, synthetic construct
RIRLFNKMLRWLKKYLALKLALHKIALNRLRIRRQKGFRFADRIRFDKQNRAQAAKVL

SEQ ID NO: 6924 - protein, 36 aa, synthetic construct
KYKLYHKFLRFLNTYRMKRALHAKNLSKMLGAAKRF

SEQ ID NO: 6925 - protein, 23 aa, synthetic construct
FLRLYKKLLKKLKRVATLRLELR

SEQ ID NO: 6926 - protein, 41 aa, synthetic construct
RFKLFKKLIRRLRKQCKAKAELTKLWLLKFIYANCKAKPEL

SEQ ID NO: 6927 - protein, 30 aa, synthetic construct
KLKYLHRLYRIFRSCLSRIIWRRELRQAAA

SEQ ID NO: 6928 - protein, 46 aa, synthetic construct
KFRFIKKFWKRMRRRALLELSLAATGGQRSAEKKRHLTSKHALMAC

SEQ ID NO: 6929 - protein, 73 aa, synthetic construct
RLKWFKKIFKRIRTALYALKRAHKNAWETKANRASFCVLRKLRGMRAKKSHFWQLNDLGRRKNALPALAHSDL

SEQ ID NO: 6930 - protein, 39 aa, synthetic construct
RMRLFKRLMRKFCKHLLDSPGNAGAIAETRAAKRMANLA

SEQ ID NO: 6931 - protein, 33 aa, synthetic construct
RLKIYRRWWRKLRRKLLKLRAALAEKGKLPYPP

SEQ ID NO: 6932 - protein, 32 aa, synthetic construct
LFRFYRKLFRFYQRKMLLKEKKRAHLGLLLST

SEQ ID NO: 6933 - protein, 24 aa, synthetic construct
KLRLYRRLLRFFQKRLCGYAARAI

SEQ ID NO: 6934 - protein, 21 aa, synthetic construct
RMRLLRRLLRMINNRALMGIK

SEQ ID NO: 6935 - protein, 20 aa, synthetic construct
LLRLLSKYIKMLKKAESFAR

SEQ ID NO: 6936 - protein, 35 aa, synthetic construct
LLKFMQKILRKFRQLRMYGELAAALAKRKHACESH

SEQ ID NO: 6937 - protein, 52 aa, synthetic construct
YMRLLKKWLRRLKREKLERKMSCLIAAKANSAFARAYPWVCLDIARDIKWLM

SEQ ID NO: 6938 - protein, 48 aa, synthetic construct
RYRWFRKFLKLWSNRAHLRDKLRLPKRVALLAVLLYGKLVGPVARQAS

SEQ ID NO: 6939 - protein, 94 aa, synthetic construct
LMKFWKRFFKYMKKRAVYRRKKLGKLRRVAKGDKSQKAARTCLRQLQMYLTKLLMYGPAKHAPRLKCDAKICSTLQKAGFYRRAPKLVAVMKRA

SEQ ID NO: 6940 - protein, 29 aa, synthetic construct
RLKILQRLFRFWNKFRLVCAARSCNARLS

SEQ ID NO: 6941 - protein, 22 aa, synthetic construct
RMRLYQRWMRLMKKALPRLEAK

SEQ ID NO: 6942 - protein, 54 aa, synthetic construct
RLRYLKKFYKWLNTGAIKAKANARRTLAHAHFFGDAKAVGGKRWMRKLLACDLK

SEQ ID NO: 6943 - protein, 44 aa, synthetic construct
FLRFFNKFWKKYRRKELHTKANKLELQLEFATDKAPAALKLAMK

SEQ ID NO: 6944 - protein, 33 aa, synthetic construct
MFRYLRKLLRKIRKLADRLMRRMADQMTKAANR

SEQ ID NO: 6945 - protein, 58 aa, synthetic construct
KLKLLRKYLKFLHPAFSYAFAVKGVTRANRFARITMGSARLVAATIALKQLHHRRARS

SEQ ID NO: 6946 - protein, 46 aa, synthetic construct
KMRIMRRWYKLWKRTAADIKRLALDAKWLLPELARNGPDARAHRLL

SEQ ID NO: 6947 - protein, 28 aa, synthetic construct
RMRLYKRFIRKWKKANLEAMSLKANGFA

SEQ ID NO: 6948 - protein, 44 aa, synthetic construct
KWKLLKKLIKKFPKEATKWTLNLALHPRTLIKAAQKKVIASMRA

SEQ ID NO: 6949 - protein, 70 aa, synthetic construct
KYRFLKRILKRMSRMLLAAWLYNWRACLWDARLGHLACAQMKMQTAARKYFDRKLYSARWLWSIAWKKAL

SEQ ID NO: 6950 - protein, 91 aa, synthetic construct
RIKWWRRWFKRLKRARRRAMPPRYNHARKAALKKAVASLARWLRMHTRTKRRSQLFDALYARARYYFAMYMMNDFILRKADWLAKLAEQKF

SEQ ID NO: 6951 - protein, 32 aa, synthetic construct
RLKFYCKYLKKFRRAHKWGAFLRILLGVKLYR

SEQ ID NO: 6952 - protein, 26 aa, synthetic construct
LLKIFKKLLRRMNKLKAEIWLLAKIG

SEQ ID NO: 6953 - protein, 22 aa, synthetic construct
RYRILRRYLRRFKPALFRLVLD

SEQ ID NO: 6954 - protein, 47 aa, synthetic construct
MWRLYRKWIRKFRKCVGRKTLLRRCAAAALMRMARWRVKLSGDAVWF

SEQ ID NO: 6955 - protein, 48 aa, synthetic construct
RLKILKKFLKIIRSLLQKYAKKFKCEALFLQSVNYPLKKAARPARLSD

SEQ ID NO: 6956 - protein, 100 aa, synthetic construct
IYRLYTKMFKYYHRKNRYWSIIFKVKRALEALALKRKILLLHLVALTNCAYAKRKYTRTAKMLRRCVEKLCRFAALWCKCMFRKWKARVSTAKAAKLKDW

SEQ ID NO: 6957 - protein, 25 aa, synthetic construct
KFRYLRRYLKLFNRAALKFLARKAL

SEQ ID NO: 6958 - protein, 36 aa, synthetic construct
MLRFLTRWFRKLHHKNARLARAKSAFATYNRHDAMA

SEQ ID NO: 6959 - protein, 24 aa, synthetic construct
KYKWYCKLFRKLKKYLALTELRQW

SEQ ID NO: 6960 - protein, 21 aa, synthetic construct
LLKMLHRFLRKMSKLEQAGRY

SEQ ID NO: 6961 - protein, 42 aa, synthetic construct
LLRIWKRMLRRLKRLALCLKKKMRTAKQEAHRKNLANAYSCL

SEQ ID NO: 6962 - protein, 43 aa, synthetic construct
KLRYLRRFYKLLSKKKRRKRYKNAKLLARGYFKAWMMAYVATA

SEQ ID NO: 6963 - protein, 64 aa, synthetic construct
KIKLMKRYLRKIHKKRNCTRLWLAAWKRAGKKPKQALFAALSALKRKEGLNKHAVEMVLRMRAT

SEQ ID NO: 6964 - protein, 51 aa, synthetic construct
KLKWFNRMLRRFKKLQLAKLRANINFGSLCHCCRAPPAKNCKFLAILLKAL

SEQ ID NO: 6965 - protein, 54 aa, synthetic construct
RFKFIKKMMRKLRRRRQRKRDLLSLWQALLVLALGLYCCKVPKELAGRRLRDVR

SEQ ID NO: 6966 - protein, 28 aa, synthetic construct
KFRLMRKFLKKWCHAQKYLDMALAQRCA

SEQ ID NO: 6967 - protein, 52 aa, synthetic construct
RWRWLRKLFRKYCKIKKEAKAGHPARKHADLRLLLPRGTLHKYNVPLVMHKA

SEQ ID NO: 6968 - protein, 23 aa, synthetic construct
LLKFFQKLFRLMCRRDAKRAAAR

SEQ ID NO: 6969 - protein, 24 aa, synthetic construct
RMRLYKRLFKRFKRGAEFPAPLEL

SEQ ID NO: 6970 - protein, 57 aa, synthetic construct
FYRMLRRWYRLLRCKPQDRRAALARHKYNKEMTAFRALRKTLAKYRWAPRLMLLFEI

SEQ ID NO: 6971 - protein, 48 aa, synthetic construct
FLKILKKLMKRLRPCDVPAAAKHRIRNRLKKLSYDASKAWEAKKAWRY

SEQ ID NO: 6972 - protein, 34 aa, synthetic construct
KLRLLQKMYRFLRCRALEWVLSEKKNLERTLVAL

SEQ ID NO: 6973 - protein, 33 aa, synthetic construct
WLRIIRKILRFLKRRDKKLNLCIAQIFRAKHIA

SEQ ID NO: 6974 - protein, 25 aa, synthetic construct
WWRYMQRWLKLLTKAPRKNLQRWLA

SEQ ID NO: 6975 - protein, 22 aa, synthetic construct
LLRLFRKLIKKFKKLKPAELRL

SEQ ID NO: 6976 - protein, 31 aa, synthetic construct
KLRILPKLYKLLRKWLGITLRWSRFLEFRAA

SEQ ID NO: 6977 - protein, 22 aa, synthetic construct
FMKLLRRIFKKLRNLAARHCHE

SEQ ID NO: 6978 - protein, 56 aa, synthetic construct
LLRYLTKLLRLYHRHNGPQWNGGGARMKAGIRLKKQKLKAQAAEVRLKKAARMIRE

SEQ ID NO: 6979 - protein, 30 aa, synthetic construct
FFKWYRRLIRMLRCLKLDCSARRLHVRARV

SEQ ID NO: 6980 - protein, 34 aa, synthetic construct
LMRMYRRLFKRWKKFALHFAYRLRFKRRRLIAAA

SEQ ID NO: 6981 - protein, 30 aa, synthetic construct
RIRMLTKLFKFFKKTLPIPLKALALLKKPQ

SEQ ID NO: 6982 - protein, 48 aa, synthetic construct
WFRLLKRFLKLFKRAGVKHAELGTCRLRQHAELRFSLYCCKCKRGKLA

SEQ ID NO: 6983 - protein, 29 aa, synthetic construct
FMKFFRKIWKKLKNVDAMKKLAAHLKYAC

SEQ ID NO: 6984 - protein, 37 aa, synthetic construct
LLRIMKRYMKFYHKLPAPNMRTLKALWLKLQVSKKKR

SEQ ID NO: 6985 - protein, 80 aa, synthetic construct
KFRLYKKWMRKLKCQKVNHDMKLMIWCKDKLECKKQRCGLLKKLMLAFLAWLAVNARKRRLHDALSLKTKAIKALKEGPI

SEQ ID NO: 6986 - protein, 62 aa, synthetic construct
RLRMLPRFLKYLRKWKKKARVLDRKEGLGPQAGHKFRKITKLIAVALRYKAKRATSIGANST

SEQ ID NO: 6987 - protein, 29 aa, synthetic construct
KFKFFRRLLRILRSWARWVLDQALRAYRM

SEQ ID NO: 6988 - protein, 43 aa, synthetic construct
KFKIMNRYFKKFRKMCKPAALKLRDKRAWTLPRWLRELMQAFL

SEQ ID NO: 6989 - protein, 34 aa, synthetic construct
RFKLFKRLFRLIQNTQAKAKKALILLERIHLKKP

SEQ ID NO: 6990 - protein, 25 aa, synthetic construct
RFRLLSKWLKKLCKALRIQLKEHLA

SEQ ID NO: 6991 - protein, 42 aa, synthetic construct
RLKIYCRWLRMFKRLKLHKWSGRLPLKAPEAKAAKVSGLFIL

SEQ ID NO: 6992 - protein, 44 aa, synthetic construct
LLKLMKKFFKRLKNSKLALRANMEKKKKRLVALELSVKLNTYWP

SEQ ID NO: 6993 - protein, 39 aa, synthetic construct
KLKLYKRWLKFLRSAYLGAILWPIRMKFFATKLMDKKDR

SEQ ID NO: 6994 - protein, 45 aa, synthetic construct
RMKLLCRLLRLFRPAAKKYIALKKVQKHKARHRKCTNRLKTGLWL

SEQ ID NO: 6995 - protein, 79 aa, synthetic construct
LIKYMKRFFKRLHHKKPKDRACVLIARCKDLAIKNLRNKLKRRANLRCIARVLAASAVNLTNDSLLGLKDKMAKLAYDM

SEQ ID NO: 6996 - protein, 95 aa, synthetic construct
MLRLFSKYLRKLRKLQLWLKCCKRALGKMKRATLKRAKKARCWQKRPRLLCGLMHQVTGYKMAANKVRAAQSLVRKGLHLHDVKPLFDLERFKRI

SEQ ID NO: 6997 - protein, 32 aa, synthetic construct
IYKMLKRLFRRFPRAKAKTASLIYKGARFMAK

SEQ ID NO: 6998 - protein, 67 aa, synthetic construct
LLRLYTRLLKLISNEAWALRGQCCLRYRACSARKRRLREKRDAQNFRGDSLEAKRALQLLRRKESTG

SEQ ID NO: 6999 - protein, 93 aa, synthetic construct
IIRFLKRILRRYRSYRRLDKEEVNMDRDLFKKGYAALRDRCKKKRLFPFKHAARRYACKLANNRMLLKKLQQAPALKDLKDFARKLADWSLNN

SEQ ID NO: 7000 - protein, 29 aa, synthetic construct
WMRLISRWLRMFRRRVRGAPARRLPHAFA

SEQ ID NO: 7001 - protein, 45 aa, synthetic construct
RLRLLPKFLRLIRRKAWVALVARLTRCREGKSAKLVVMFWVLRQM

SEQ ID NO: 7002 - protein, 41 aa, synthetic construct
KFKILNKLLKRICKLLNALLLTLKTGLMGFEHKHVAKKRGK

SEQ ID NO: 7003 - protein, 25 aa, synthetic construct
KYRLLQRLFRKFPRLANYLANRFHS

SEQ ID NO: 7004 - protein, 56 aa, synthetic construct
RLRMWPRYMKLFRRRAKIILANKRLYAKARLCNGAARFCLRLCVPERVALLTFLTY

SEQ ID NO: 7005 - protein, 23 aa, synthetic construct
FLRYLRKYLKRFRNKKLAKSLPL

SEQ ID NO: 7006 - protein, 86 aa, synthetic construct
KFRFYRRMLRRLRSRQLCRVFLKLARRAEVNAKNRLLIALQAASPFRKSTAAHVSRKKDARRKDIWEMSLALLAAQLKKGKDRRLK

SEQ ID NO: 7007 - protein, 43 aa, synthetic construct
KLRLLPKWLRKFKSLQKILKMKSRDNGVCAKAHLCLLARARRK

SEQ ID NO: 7008 - protein, 96 aa, synthetic construct
KLKYLKRYLRRFHNAKYCLLDAKYKIDKIQAEPYVDDGKAPARKWLHNAATAHACKLARHTKLRQCEKKSMTKKADANARCAKKAPRKHLKSRLSA

SEQ ID NO: 7009 - protein, 33 aa, synthetic construct
RLKLYKRLFRLFQKKKAGFNGRLLLTAGMKDKE

SEQ ID NO: 7010 - protein, 38 aa, synthetic construct
RLRILRRLLKMLRRRFWAVGAYSRLDLLRLINWIEDFW

SEQ ID NO: 7011 - protein, 32 aa, synthetic construct
RFKFFSKLLKILTKATRMGVAFAKLNFIRARL

SEQ ID NO: 7012 - protein, 82 aa, synthetic construct
RLKYFPKFFKWYRSWALYATLRRHWRTFGALRKMLKRKCSTARMRFTWARIYLKSLQWLGIARKEKLKLKPKRCRKLSDLKL

SEQ ID NO: 7013 - protein, 31 aa, synthetic construct
FYRLFRRLMKYIKRAKLKRMQARWKLLNDLL

SEQ ID NO: 7014 - protein, 80 aa, synthetic construct
LMRLLRRLLRKLRKLPPLNWMCTRKANALRAGGLKNHNLRDRIPYGLKLKSQLVMWVRGYIFAKPCPARAEYRKELRRYL

SEQ ID NO: 7015 - protein, 34 aa, synthetic construct
KIKLYKRLFRMLRKRGAWADYYYTRDTLFLEARR

SEQ ID NO: 7016 - protein, 23 aa, synthetic construct
LMKIYNKYLKRYRKGRAWILKLL

SEQ ID NO: 7017 - protein, 37 aa, synthetic construct
RFKFFKKLLKKLQTLDNEFLRAPMASVQNRLARAREK

SEQ ID NO: 7018 - protein, 54 aa, synthetic construct
RFRFLKKFLRKLTHCTKECKPQWIQCLLGQWTSLKYFKGAATLKAAAALLRRRA

SEQ ID NO: 7019 - protein, 56 aa, synthetic construct
LLRWLCRLFRWLRCRKKAHPVLLKETYKKVIHGAGRREKKLKHKAKFLLLLKNDQA

SEQ ID NO: 7020 - protein, 57 aa, synthetic construct
LIKLYRRIIRRFKSHKVLVAGQRLITCLAKMVTTCADVLALLRALLRKALGSFLRKK

SEQ ID NO: 7021 - protein, 30 aa, synthetic construct
LYKLIKRMLKKWQRLAVLRKARRRDLGYTC

SEQ ID NO: 7022 - protein, 23 aa, synthetic construct
KLKLFPKFLKRLRSALSHKMVDS

SEQ ID NO: 7023 - protein, 64 aa, synthetic construct
FMRFLCKLFKLLRNALKKQCLRMKKQKRKIRLRLCNLITKAGGRIDLLTPLHNAPRRKEAKLLK

SEQ ID NO: 7024 - protein, 52 aa, synthetic construct
RLRMLRKMFKKLKHELRWAPDAKELHPLKKARKRQLLQATAPTSQHAYKRSV

SEQ ID NO: 7025 - protein, 36 aa, synthetic construct
RLRMLPRWWRKLRKLVSIMLTKKALRTCQRAPAGDI

SEQ ID NO: 7026 - protein, 26 aa, synthetic construct
WMKFLRRLMKRLRQMAACGRARQKLL

SEQ ID NO: 7027 - protein, 64 aa, synthetic construct
RLKLYRRLFKRLSKRHQMNDDHRREEKALHLARAKGTRCLACSPQFEKPLFLLARSLKLRTRLY

SEQ ID NO: 7028 - protein, 35 aa, synthetic construct
KFRILKRFMKKWSKGPHLLRARACDEFIRKLALGA

SEQ ID NO: 7029 - protein, 20 aa, synthetic construct
MWRLLPRLYKLMKQAHEKQR

SEQ ID NO: 7030 - protein, 20 aa, synthetic construct
IIKYITKLLRIFRKAYLKLV

SEQ ID NO: 7031 - protein, 32 aa, synthetic construct
KIKLWTKLFKYLQKILLRPLRRYRLKAICLSK

SEQ ID NO: 7032 - protein, 38 aa, synthetic construct
KFRFFKRMFKKLKNRPRRLVKLDSMLSIRLAQILLYYA

SEQ ID NO: 7033 - protein, 25 aa, synthetic construct
RLRWLHRLYRFLRHLLVVVKKSWRA

SEQ ID NO: 7034 - protein, 40 aa, synthetic construct
KLRWLRKFFKRFQRMTKLWELRKHYRLDAGCDKLAQARSA

SEQ ID NO: 7035 - protein, 31 aa, synthetic construct
IFRWWRRLIRKLTNKLARCLLLVRFQRHAAK

SEQ ID NO: 7036 - protein, 36 aa, synthetic construct
KYKYLKRFFKMLTKLYRLKLALLIWMNKKAILKAWR

SEQ ID NO: 7037 - protein, 25 aa, synthetic construct
LFKWWKKMWRRLRKRTKALNLLHVA

SEQ ID NO: 7038 - protein, 20 aa, synthetic construct
KFRLITKLWRRLQKPQEAEL

SEQ ID NO: 7039 - protein, 76 aa, synthetic construct
RLKYFRRLLKRIRKRASKACGRGMKMRERRAKSLLGFYLIRNCAVLLLAGGYRMAHPDQAPASRLHLRDCVTYRAL

SEQ ID NO: 7040 - protein, 52 aa, synthetic construct
RIKYLRRLLRYLRNDLYYIKIKAYKAADLWRLKAYMRARWIPIRLPTALKIL

SEQ ID NO: 7041 - protein, 20 aa, synthetic construct
LLRLFPRMMKRLKTKTAAAN

SEQ ID NO: 7042 - protein, 60 aa, synthetic construct
RWRFLNRIIRFFRNKLLAIKALVALACKYMKQGNKAENKKTRALKDKKMLPKGDPIKWLA

SEQ ID NO: 7043 - protein, 28 aa, synthetic construct
LLKLLRKYFRKMKRMLALASKDKRLTEA

SEQ ID NO: 7044 - protein, 28 aa, synthetic construct
KWRMLRKFLKKLKRLRDLASGFFVPAGT

SEQ ID NO: 7045 - protein, 22 aa, synthetic construct
LMKLLRRLYRKYKRVLALVSAC

SEQ ID NO: 7046 - protein, 29 aa, synthetic construct
RFKMWKKFYRKLCRDAAFAALARVSCYLS

SEQ ID NO: 7047 - protein, 30 aa, synthetic construct
YLKFFKRLLKWMRNGVKWQRLPLLLKLRRA

SEQ ID NO: 7048 - protein, 66 aa, synthetic construct
FLRLLNKLLKWLNHKLKAPGKRKCFHLADLDRMYADCMAFKRNMKWARTAVLKCALARNTGRWLRL

SEQ ID NO: 7049 - protein, 77 aa, synthetic construct
LIKLFRRFFRKLKRFRAKRLRMANESGAGRCAMTANARAVAMYRCLEAVIPKFRGRQCKYACLMKKLKRRNDNKRTA

SEQ ID NO: 7050 - protein, 21 aa, synthetic construct
KLRLMTRWIKRIKRVAAHLNS

SEQ ID NO: 7051 - protein, 38 aa, synthetic construct
LLRLWKRIIKLICKARAFRKDSRLNSECTLAPSILAEK

SEQ ID NO: 7052 - protein, 50 aa, synthetic construct
LYKLLPKLWRKYKRAKRSLRAKKRPFCQRRMLLLVAQMPWELERKPAMYC

SEQ ID NO: 7053 - protein, 27 aa, synthetic construct
KLKWWHKLFRRLRRLGLLLGELRARLM

SEQ ID NO: 7054 - protein, 28 aa, synthetic construct
KWRWLHKLYKMLRRLWVLMAAAKLRMRN

SEQ ID NO: 7055 - protein, 72 aa, synthetic construct
LFKYYRKYFRKFRCLRYKPMTLEEYYTRPQALLGAIKLRKLKLLYIASDAVRLKKNKLCVKLTRKLWLKGGK

SEQ ID NO: 7056 - protein, 59 aa, synthetic construct
IWRLLKKLFKYIRKLKLWERPPCRRRKRLKRDLLLADKKYLTPQRWHMLLLNKLRNTFP

SEQ ID NO: 7057 - protein, 28 aa, synthetic construct
MIRWMHKLLKRLRKLRRTAESWYSLAKQ

SEQ ID NO: 7058 - protein, 25 aa, synthetic construct
WWRFLRRFLRKLKKERNAAAKAMNC

SEQ ID NO: 7059 - protein, 23 aa, synthetic construct
LIRIMKRLFRKMKNKGLDTAAAY

SEQ ID NO: 7060 - protein, 25 aa, synthetic construct
MLRYYRRILKWYQKALRKALLEFCQ

SEQ ID NO: 7061 - protein, 37 aa, synthetic construct
KYRFIKRLLKRLNQRLKQALCTKWRAAIKKTEYVAML

SEQ ID NO: 7062 - protein, 86 aa, synthetic construct
KIRLFPRFWRRIKKQAETKLLGTLVQPLKKEKWAKCERAALRKNKRARAHRPALAVKCPGEKAKTELWYRSRLSHFAKMAYAKMAL

SEQ ID NO: 7063 - protein, 48 aa, synthetic construct
LFKLFRKLFKRMRRGNWKVAKAKSAKLIKARETAQITRYGFDAKLKLH

SEQ ID NO: 7064 - protein, 53 aa, synthetic construct
FFRLLRRWYRLYQRIRKMKRAHGVAYWLRDFRRAQRLLAAAKMKRFKFLNDNL

SEQ ID NO: 7065 - protein, 51 aa, synthetic construct
KWKMYRKLIKWFKCARLKLCKIKMILLTAWRAKAHARLRLKAITKAADRRL

SEQ ID NO: 7066 - protein, 76 aa, synthetic construct
RMKFLNKWLRMLRSGVTRYAARKCHMQRLRQPLKKRCAGRRVLATSLRKAFPLSAAQDLMHFARIFLLWAFNRRRA

SEQ ID NO: 7067 - protein, 27 aa, synthetic construct
FLKILRRLLRRLKQAASKRYAFYCLIW

SEQ ID NO: 7068 - protein, 45 aa, synthetic construct
LFRLIRRLMRKLCKRYAPLYNNKIMRILKIRKEGFALAKATGAYH

SEQ ID NO: 7069 - protein, 31 aa, synthetic construct
WLRMLRRLFRMLKKVKSGLVVCKAKRNSLAR

SEQ ID NO: 7070 - protein, 37 aa, synthetic construct
RIRFWKKLLKKLRCLAALLRMRAQNYRRIKAARDLLG

SEQ ID NO: 7071 - protein, 20 aa, synthetic construct
LLRILKKYYRRWRRNAQATW

SEQ ID NO: 7072 - protein, 24 aa, synthetic construct
MIKLMKKLIKFMNRRRNQLALDRL

SEQ ID NO: 7073 - protein, 27 aa, synthetic construct
KLRWFRRYFKRLKHLVSVASRACLIRA

SEQ ID NO: 7074 - protein, 49 aa, synthetic construct
RLRMLQKLLRKYSTKNEGQLALLWFRLSSLLLKRHAAWRACRWAYRMNN

SEQ ID NO: 7075 - protein, 23 aa, synthetic construct
RYRLIRRLMRKLTKAQATWWLAK

SEQ ID NO: 7076 - protein, 47 aa, synthetic construct
KWRLLHKLLKRLKKADLNMPRAKRRIAVVLMPHLIKTSTKWSARGRA

SEQ ID NO: 7077 - protein, 68 aa, synthetic construct
KIKFFKRLIKWLQKEWHELLKTTYPWKLRKRARLALNFVLFFRRKLPQADYYLCRALSVRKARHIRRK

SEQ ID NO: 7078 - protein, 50 aa, synthetic construct
RFKILSRFLKYYQKTLEYLAALKQKYEPFYLQKKLKKEIEAAKRARPLAF

SEQ ID NO: 7079 - protein, 30 aa, synthetic construct
WWKLLKKLYKFLCKHAIKIDRKKKQMLFAH

SEQ ID NO: 7080 - protein, 29 aa, synthetic construct
RYRMLRKWLKFLRNPALRCNLDHLDARKF

SEQ ID NO: 7081 - protein, 21 aa, synthetic construct
MLKFFKRLFKLLTKHHQKLHK

SEQ ID NO: 7082 - protein, 32 aa, synthetic construct
FWKLLRRFMRRLTRERTHFELKFAAILLRWLR

SEQ ID NO: 7083 - protein, 81 aa, synthetic construct
KMRWLHRILKKIKRANLRSRRFAGNHRENNLQASKKLSPRSDADDRAKAKGAGNKVRTYAHLALKEHPSKAAKHKRLLQRL

SEQ ID NO: 7084 - protein, 30 aa, synthetic construct
RLRLWQRFLKRLKKAWCLSLVKIDLAFGRI

SEQ ID NO: 7085 - protein, 30 aa, synthetic construct
MFKLFHKFIKLFSQAMLLKLWKARAMNKAR

SEQ ID NO: 7086 - protein, 39 aa, synthetic construct
WLKLLKKFFKLWNKQIKAFRAKLARQAKKHPFHFYAMRC

SEQ ID NO: 7087 - protein, 68 aa, synthetic construct
KMKYICRLLKRFKQNLLKLRMYRLKRKVKERLPNEAAVQPVAKWLLKTTKTPTLRKMYLKSAARRFLY

SEQ ID NO: 7088 - protein, 40 aa, synthetic construct
RLKWYQRMLKRLSHGKKALRARGLRWLCDLKFLSLARGIR

SEQ ID NO: 7089 - protein, 32 aa, synthetic construct
RMRLFRKIFRRYNRAVWTWRAQKKLCQAIAAA

SEQ ID NO: 7090 - protein, 21 aa, synthetic construct
RLKILKRYLKLLQNRYSTYKA

SEQ ID NO: 7091 - protein, 62 aa, synthetic construct
YFRFWRRYWRKMNKNKLVKRMKKHRNRRKAEALLHCKTIRCKLIHAWALLYQRHTLKLLNAA

SEQ ID NO: 7092 - protein, 29 aa, synthetic construct
RWKLYSKILRRYCPLLRDERRAAARRACL

SEQ ID NO: 7093 - protein, 68 aa, synthetic construct
LWRIICKLLRKFRHLRLEREKLLLAKYNRRRLALMARDARKHCAHAYEKLLIDPKARRKTTYRKGDKH

SEQ ID NO: 7094 - protein, 25 aa, synthetic construct
LYKLLNKLLRRISKGKLFADLILRK

SEQ ID NO: 7095 - protein, 81 aa, synthetic construct
IYRLIKKFYKKISRKPKAGAARCNKLFAIRMKALIIIRALAFLAAHIANADLLSRKAILELKTIKARKWKRRTLWGMLRSW

SEQ ID NO: 7096 - protein, 23 aa, synthetic construct
KLKMLKRLYRRYTHYLLSLMRCD

SEQ ID NO: 7097 - protein, 80 aa, synthetic construct
RLKFFRRFWRKLKKALLFSPLKLFVADIADMTQFKWKAQKLCVLNRCAAAGLASPKKKIKWKKRRFNRLKEAEPPALMRS

SEQ ID NO: 7098 - protein, 55 aa, synthetic construct
MMRYMKRILKKLRKAAGARPLQRAKAFRWLDLKLKLNDASARYWIRKKAWQKYWN

SEQ ID NO: 7099 - protein, 82 aa, synthetic construct
RLRLLRKLIRRLCKAFWNGRYLLLEEAKQCALSRMWRRQKLKPYCGRQLLQRKKRKAWCAEETARHAQYRAKECIKRRARHN

SEQ ID NO: 7100 - protein, 34 aa, synthetic construct
FLKWWPKYYRKYRRNQQGSKNLKANPLLLLRAAA

SEQ ID NO: 7101 - protein, 32 aa, synthetic construct
LFRLLTRLWKKLTKQSWTMKHLFRAKLQLEKC

SEQ ID NO: 7102 - protein, 40 aa, synthetic construct
LLKYYNRLLRLIRPAFKRKMIEKARKAWKRCRAQKSRLLI

SEQ ID NO: 7103 - protein, 56 aa, synthetic construct
LMKWWKRLFKKIRNIKAETAQLRFPYTWRKCQAMLKYRRSREALILKKALLFLFMR

SEQ ID NO: 7104 - protein, 21 aa, synthetic construct
RLRMLPKIMRFFRREAAKVAI

SEQ ID NO: 7105 - protein, 43 aa, synthetic construct
KLRLIKRLIKRMKTHMNAWAHRHRAAAKTYLLRQREITFKAPF

SEQ ID NO: 7106 - protein, 28 aa, synthetic construct
FLKLIKKFLRMFNRAAYLFLHRKLKRLR

SEQ ID NO: 7107 - protein, 80 aa, synthetic construct
KLKILHRFFRRMKSNLQRLALPRANLKMAPNALYPGAMRHRRMRRKIKHLCASAAENAAKAMNRKVKRQVHSVAGYELKR

SEQ ID NO: 7108 - protein, 41 aa, synthetic construct
KIRLLTKWWKFWRRAYAAQKHLRLRLASSRSLLWNRPWLAT

SEQ ID NO: 7109 - protein, 35 aa, synthetic construct
RYKLYRKLFRRFNKRAMKRHAKQLWEHKGASAAAA

SEQ ID NO: 7110 - protein, 86 aa, synthetic construct
MLRFYRRLLKFFKKLRNGRRWMGKLKDWEKCECKLDLRRARTKHAAKKAAAGMRGRRILNQEKAKPLRKTRPNNHCLFSANLKLLR

SEQ ID NO: 7111 - protein, 25 aa, synthetic construct
FFRLLRRLLRILRRTLEAHRGFELH

SEQ ID NO: 7112 - protein, 65 aa, synthetic construct
MYKFYTKFFKMYRRKHAVDALGRSNLLNNQILRRAEDARLRYPKAARKYRALNKAMWKLALRLDR

SEQ ID NO: 7113 - protein, 37 aa, synthetic construct
WFKLLRKLLKKIQKQPFSLARCLCLPRLHCERQAKLC

SEQ ID NO: 7114 - protein, 50 aa, synthetic construct
MLRFMRKYIRFFRNAKVKKPAALRKPNNNAKLLILKSVAIALYSVLRGKR

SEQ ID NO: 7115 - protein, 94 aa, synthetic construct
FIKLLRKLLKIYKRPTDLMKRRRTALAKWRRNRDKCALKADLIPAASCCLRMWSRIKIMRLMAVKRGYKLKEYLMATDRLEAKARRHELRIAGY

SEQ ID NO: 7116 - protein, 34 aa, synthetic construct
KWKLLQRILRFMKRPKFAAFAKKGNQSARKMNLF

SEQ ID NO: 7117 - protein, 76 aa, synthetic construct
KLRYYCRMLRKLSTARMACTKQKPLLTKRGLHHLGGLRDMSRHMLKGRHQDRAAKVNKAKLWVLLLRDAKLGRRHY

SEQ ID NO: 7118 - protein, 26 aa, synthetic construct
LIKLWQRLLRKLRTKEPVVRLPRNRA

SEQ ID NO: 7119 - protein, 34 aa, synthetic construct
KLRFFHRLLKKFPQLDLKIKAHKLRKAISRPRAS

SEQ ID NO: 7120 - protein, 21 aa, synthetic construct
YLRMWRKLLKRLNRTAKMHML

SEQ ID NO: 7121 - protein, 75 aa, synthetic construct
KWKYYPKIYKFLRQKKVPAHARADLALQMATAFEAKFCRRKALARILCYKIEHYHKKLRMKMLRKKKAKRLLHEM

SEQ ID NO: 7122 - protein, 56 aa, synthetic construct
KLRMLKKFLRLLRTDKAQHRALRCRMSQKQLKATWRLAVLKNLAQALKKYPEPSSN

SEQ ID NO: 7123 - protein, 29 aa, synthetic construct
RYKILCRLYRKIQHALTKKVAALRQSKFE

SEQ ID NO: 7124 - protein, 33 aa, synthetic construct
MFRLMKRYLKLLRRAYYNLVKVKLKKIDHLYIL

SEQ ID NO: 7125 - protein, 75 aa, synthetic construct
LLRLFQKFFRRLNKAWASTRRAKLAKWELRFRRQFGPRASLLRHTIHPLARKLLILDFRAPRLATPKPRKICRNK

SEQ ID NO: 7126 - protein, 53 aa, synthetic construct
RLKYLKKLFRKFRKELMAYSLLKAWGKVACLTASCQASQKRAQPAKHAAQRGF

SEQ ID NO: 7127 - protein, 55 aa, synthetic construct
LYRLFCRIMRKIKRRFKLYAMLRHIAAAKILVKANARRKAHGGAWDSRAALWAII

SEQ ID NO: 7128 - protein, 30 aa, synthetic construct
RMRFLRRFLRKFKQATVAKYARLRLRCWAC

SEQ ID NO: 7129 - protein, 61 aa, synthetic construct
KLRLMHKLFKRMSCAALDAYLKRDRKLFAKQAYSLFTCHVLNKLLANKRKVSALWDLRPPF

SEQ ID NO: 7130 - protein, 40 aa, synthetic construct
LIRLLRRIFKILKCAKEPKLAAEAKCKHARLAAQKRKLCT

SEQ ID NO: 7131 - protein, 29 aa, synthetic construct
KLRLLNKLMRFLQRVQLQMQEKAHLRKLL

SEQ ID NO: 7132 - protein, 48 aa, synthetic construct
FIKMLKRFIKRFKRNADAPQSRKIAAALLLARTAHLLIVFNKLWAFKK

SEQ ID NO: 7133 - protein, 26 aa, synthetic construct
LFRLWKKMIKKLKTAAKPLGKNARRA

SEQ ID NO: 7134 - protein, 24 aa, synthetic construct
KMRLLSKFLKLLKKSTTEGIYKRA

SEQ ID NO: 7135 - protein, 34 aa, synthetic construct
KIRLWRRFFRMLSPLLRAFKFADAMRLRWRALKK

SEQ ID NO: 7136 - protein, 32 aa, synthetic construct
KLKYLPRLFRKFKHQWARDRLICLLPWRVARN

SEQ ID NO: 7137 - protein, 33 aa, synthetic construct
LLRMLNRILRRLTQYLKEGAGKRLPRKRLVKCK

SEQ ID NO: 7138 - protein, 22 aa, synthetic construct
LLRYYRKLFRMMCKAAALRLES

SEQ ID NO: 7139 - protein, 40 aa, synthetic construct
RFKLLKRFWKFMPRHLLHTWANAVKKNTKKMAKLARTRAQ

SEQ ID NO: 7140 - protein, 38 aa, synthetic construct
LYKWIPKFWKKFRNVAHRVRLKALLASHKAPAKRDVWK

SEQ ID NO: 7141 - protein, 100 aa, synthetic construct
RMKLIRKWYKKLSCKHRRRAKSEVYKAMARYLIKKGERSKRLLGSALKLDLLTRHGGPAPKLVDWKLLAGKSAKQCPNAFDLRIYEGRKKMLKLMKNRYR

SEQ ID NO: 7142 - protein, 27 aa, synthetic construct
FIKWLKKLMRLMRPARSLKEKCLHAKL

SEQ ID NO: 7143 - protein, 36 aa, synthetic construct
LYRLYRRMFRKWTKRKAHKKNLTLICKYALCLALPN

SEQ ID NO: 7144 - protein, 31 aa, synthetic construct
RLRWLPKFIKYLRKMCLQCAPKMQKTALALR

SEQ ID NO: 7145 - protein, 32 aa, synthetic construct
KLRFFRRFLKLYKKFMYYKLSAMDAKLMELKQ

SEQ ID NO: 7146 - protein, 36 aa, synthetic construct
LMRYLRRLLRRLKKAAQRLGKMAALKDANCFKLMIE

SEQ ID NO: 7147 - protein, 21 aa, synthetic construct
KLRLLPRWMKRYRPYWLKTAN

SEQ ID NO: 7148 - protein, 75 aa, synthetic construct
KWRWLRKFYRRFRTGKWLLDADQALAARVCLMFRKMRLFFLRKSARDRALAWCRLVRAKARSPVRLWLRWKQLKQ

SEQ ID NO: 7149 - protein, 60 aa, synthetic construct
RLKYYKRLLRLFKNMLEKNYALADRRFFLLAKTALSLACPANRFKLTKLLLKSVPQIVVG

SEQ ID NO: 7150 - protein, 42 aa, synthetic construct
LFKFLKRFIRLMKRLDCLWRKRCRKILIIVAARFLAVKGKVE

SEQ ID NO: 7151 - protein, 69 aa, synthetic construct
KWKLWKRILKIMRKRKTAAAPAVRRLAMRHVRLELELIYNENSKRRNTSARKEAIQRLRCLMRPMIELR

SEQ ID NO: 7152 - protein, 99 aa, synthetic construct
KWKIFKRLLKKLTHLPALHKKNKCNKYLYAYRKPLLKILLLNALIKSRVFRRHLAIPRCMLALPPLALKQLHQGHWEIKYLAKGPRDAWLALLLARKME

SEQ ID NO: 7153 - protein, 63 aa, synthetic construct
KMKLITKMLRRLQKWKGKFKVWPCANQLAALHLQLLKKRTTTRRDRSHRACIRGRAAALAVKY

SEQ ID NO: 7154 - protein, 34 aa, synthetic construct
RLRLIKRMFRKWQTLKLKMLGHCLKPVDALLLKG

SEQ ID NO: 7155 - protein, 23 aa, synthetic construct
RFKLLCRFLKKLRHENELAKLRF

SEQ ID NO: 7156 - protein, 43 aa, synthetic construct
KIKWWTKYLKILRPLLALKRLEKYVLKKKVEAMLSDATKWAQR

SEQ ID NO: 7157 - protein, 64 aa, synthetic construct
KFRFWKRMYKILHHLLKAEKRELRKRYLKALAALAKKRAMKYVAMTKTALRARDSRARAAQPCN

SEQ ID NO: 7158 - protein, 20 aa, synthetic construct
LFKLMKRLFKRLSSARAPKF

SEQ ID NO: 7159 - protein, 29 aa, synthetic construct
LMKYLRKWLKYYRCRAEAYQLARRLFLAH

SEQ ID NO: 7160 - protein, 40 aa, synthetic construct
RMRWLCKFMKIMRPRRALLGKAAIYYQLCRQAKAPKPSKR

SEQ ID NO: 7161 - protein, 29 aa, synthetic construct
LLKFFKKLLRWLKCEKKSVIRVLTARTAL

SEQ ID NO: 7162 - protein, 63 aa, synthetic construct
RWRLLRKFMRFLKKARKAITSNNKYGHKWAWICLFQMRFYKYAAAAQKPRRTLLKKCLAKGRA

SEQ ID NO: 7163 - protein, 73 aa, synthetic construct
RFRFLSRYLRWYKRRASAMKAIFDKARLHQKHTALRIAAAGWRRLMRTGRLKLGAVSLNPAKLLDTLKQDRPG

SEQ ID NO: 7164 - protein, 46 aa, synthetic construct
KLRFLQKWLRKLRRKISVSIRAEMKAVTLAGAVARRFDAHKARYSW

SEQ ID NO: 7165 - protein, 68 aa, synthetic construct
MLRYLSKLLKYYHRKAHKHSKANLNMNALYAAFRALRRYELALRCYAKRACYPCCMIAKWKKLSRWNK

SEQ ID NO: 7166 - protein, 38 aa, synthetic construct
LWRMWQRFIRKITKASLILHCLRNPKKDWAKLRLWAKR

SEQ ID NO: 7167 - protein, 36 aa, synthetic construct
LFRIMPRMFRKFRTAHKAKRSHYKLSLRALMLAKCL

SEQ ID NO: 7168 - protein, 45 aa, synthetic construct
KIKLIRKFLRKIRKCRWAAAVGANKAWLNAAVHAVKALTLRNLKR

SEQ ID NO: 7169 - protein, 94 aa, synthetic construct
RIKLLHRMFKIITKQRRRAMRVIAWQRLAAKCKTAHGWAFLFRRARGAESRRLADLKAGIRLHARRRVKWAAYIKIVWRKLYYAAEKKFLKKKR

SEQ ID NO: 7170 - protein, 84 aa, synthetic construct
RMKFIRKILKFLCKQRKLAVNVWAKWALAKGLSFLRAKCKPEARAMMAALKGAMKFARNLKLLSFWGVKLSAARCPPSRDPRLR

SEQ ID NO: 7171 - protein, 34 aa, synthetic construct
MLRYWHRLFRKLKRDHKKIWKADALYPNKNTAKA

SEQ ID NO: 7172 - protein, 65 aa, synthetic construct
FFRFICKLLKRLKRYLILWKKRKKALAKRLSRDHLARRKWAFKRVYFLWGTLLPAELSWYPTKLN

SEQ ID NO: 7173 - protein, 30 aa, synthetic construct
KWRFLPRMLRRLKRCGAEDMIRALRAHLVP

SEQ ID NO: 7174 - protein, 27 aa, synthetic construct
MWRLLHRFFKLFKREKVRQAAILFRLP

SEQ ID NO: 7175 - protein, 39 aa, synthetic construct
YLRLYKRWLRLYSRRLRNLLLEHYAADGKRMALNLRKWM

SEQ ID NO: 7176 - protein, 22 aa, synthetic construct
KLKLFKRLLRRLTRKLAPKEIA

SEQ ID NO: 7177 - protein, 58 aa, synthetic construct
RWRLFKRFFKRLKRSLLCKRLRGYLLVKSGADALLHARAWRRCLWAIIKQHNPNLLKR

SEQ ID NO: 7178 - protein, 21 aa, synthetic construct
RYKWLNKLWRKFKKKCLLLMA

SEQ ID NO: 7179 - protein, 22 aa, synthetic construct
KLKLFKRFLRMLCQLKGRWRLY

SEQ ID NO: 7180 - protein, 65 aa, synthetic construct
KFKFIKRMWRKITCRMAMERAALYLFKHALCNFKLRIKRHSKDHRGLALWRALAFAALLADHVAL

SEQ ID NO: 7181 - protein, 81 aa, synthetic construct
FFKMFKRWLKKMTHMKAKFILDLEMKKAPSAWNLNYAFELRRLLNKLKLNRRLKRRKVIRAPTLLSPRRKAAQQKQICSRK

SEQ ID NO: 7182 - protein, 80 aa, synthetic construct
KIKMLRRMWRKMKRCLDCLPRKRNSRLQLVAFRRALHRACRTRVKLQALARCAAYTMFKKKMLLAQYMFIAATCFKANDG

SEQ ID NO: 7183 - protein, 40 aa, synthetic construct
KLRMLRKLIKMLKSKRSILIKIKCDLYVIKRRGLLLSLLT

SEQ ID NO: 7184 - protein, 35 aa, synthetic construct
WLRYFRKMIRRLCRPLAKLLSCCLLAEGKWKKFKS

SEQ ID NO: 7185 - protein, 45 aa, synthetic construct
LYRFFQRFYKRFCKLLRKQLRHAPGRYRWLAQNTKLEYARKILLR

SEQ ID NO: 7186 - protein, 38 aa, synthetic construct
RFRMLRKFWRWLKKAFKQTLRPAAALLVATWLDAPMHY

SEQ ID NO: 7187 - protein, 52 aa, synthetic construct
IIRLFSKLYRRLKKMALRRKLLWSNVFHKFKAKYAKRCWRYNLCRFFHLIRL

SEQ ID NO: 7188 - protein, 22 aa, synthetic construct
LMRYLRRIWRLLHKEARVDQAL

SEQ ID NO: 7189 - protein, 63 aa, synthetic construct
KMRLLSRFWKLLHKRDAEVRDAILLLQVWRSRQAKNYEEAALGKAEIARRKRAKKAGRYCLSY

SEQ ID NO: 7190 - protein, 77 aa, synthetic construct
MFRMWNRLLRMLKCRKEALGFRALFARRRRELLALRALIIAWKYKEQAFRCRDRGGRDCFCKLIKKRALIWHIRVPA

SEQ ID NO: 7191 - protein, 45 aa, synthetic construct
WLRIIKKWLRLFRPFTCTRYHARLVAKFRAALLKCCLCWLARYRK

SEQ ID NO: 7192 - protein, 80 aa, synthetic construct
RLRLLRRMLKRIHNGRSNMLVRYMWAWFARCMAIKASAQIRCRLLYCADKLAKLRLKRALLKPKMKHIRRAIKFCRFAPT

SEQ ID NO: 7193 - protein, 44 aa, synthetic construct
LWRYIKKFFKYLKQAAKATRGVLRKAQRALLCGFRRKKLPMPAN

SEQ ID NO: 7194 - protein, 29 aa, synthetic construct
RLRWLKKILKMFNRKLAQHNNVYRIKGLA

SEQ ID NO: 7195 - protein, 80 aa, synthetic construct
KYRFLRRILKRLSRWRRKRYAEEARLLLYSHKNICKNACKARKRWCRVAMFHTHLEVKAWKELIKLDNAGRLAFLARLPY

SEQ ID NO: 7196 - protein, 20 aa, synthetic construct
RFRILRKFFKRMTHPLALNA

SEQ ID NO: 7197 - protein, 47 aa, synthetic construct
LLRYFRRYFRRIRQRANKALQGCELQRTAKKKKCATRLDRAEVIGDL

SEQ ID NO: 7198 - protein, 38 aa, synthetic construct
IYKFLKKLFKKINRIRARFAALLVRRRWPVNYPRGLAC

SEQ ID NO: 7199 - protein, 38 aa, synthetic construct
KWRYLNRYLKFFRRMSKARLRLLSEHLKPRKDNIASLI

SEQ ID NO: 7200 - protein, 55 aa, synthetic construct
MFKLLSRFLKILRRKKLQKYRLRYLRARNGHKLRLRLYAGQNQAVHMAQRMQTLN

SEQ ID NO: 7201 - protein, 97 aa, synthetic construct
RIKMFRRFWKRLQCVRQQRAKWRHKRAKALAALRLPMDLKVLRRPMSRMQAADATQGLCLNLVKYLQSCRRRQKLAKNGCRAMTFKALKNFLWKRKA

SEQ ID NO: 7202 - protein, 47 aa, synthetic construct
KIRFFQRLMKLITRSERDKEAKSWRLPRYLKACKRRAAHLQANARGA

SEQ ID NO: 7203 - protein, 72 aa, synthetic construct
RWRFFCKLLRKLTKRKIRTMCFAWKRLAKKGKKFALATLKNPLQELSRTRRTRHCSRADLASIGERRNLAHK

SEQ ID NO: 7204 - protein, 59 aa, synthetic construct
KLKYLHRLWKMLKSVDERHLMARAWRAKLKDQRLKKRHYMKTQAPLYRHLLLLRSQHPK

SEQ ID NO: 7205 - protein, 70 aa, synthetic construct
IFKILRKFLKFWCRKKKPLKLVWFWVKAARKLEVQAHHAPKANNARAHVHLNLRWQAKRVYKHKKKKSAL

SEQ ID NO: 7206 - protein, 25 aa, synthetic construct
LYKLMTRIIRLISRKDFALGARLLD

SEQ ID NO: 7207 - protein, 25 aa, synthetic construct
LFKLLRKMYRKFRCEPRILLLAGRN

SEQ ID NO: 7208 - protein, 46 aa, synthetic construct
KLKLLRRLYKRYHRGDRKQAMKAYNSLTNATRALLAWLRIACIKRA

SEQ ID NO: 7209 - protein, 49 aa, synthetic construct
KYKLISKLFRRMRKKMAAKLYTLLNGWHTQLRSQSALKALRIPKTRLSG

SEQ ID NO: 7210 - protein, 22 aa, synthetic construct
RLKLLPKYYRILPKVWNKPALR

SEQ ID NO: 7211 - protein, 31 aa, synthetic construct
FIRFLSKYLRLMCRALCAVRAKRNQERMKAA

SEQ ID NO: 7212 - protein, 76 aa, synthetic construct
WIKLLKKLLKYWRKYVALGKSWCANLHAARCLRKMCDHFRRYLAKKKLAHSDLQCATCHLFALDNLKEKSKACALK

SEQ ID NO: 7213 - protein, 41 aa, synthetic construct
RLKLITRILKKLKRRAAATFRLFRAQKKRLMQWRANLEVDD

SEQ ID NO: 7214 - protein, 49 aa, synthetic construct
KLRLLHKFFKILCQRRLHFFRILLLTKMLLKMAIPLTAAMARKKELKKN

SEQ ID NO: 7215 - protein, 25 aa, synthetic construct
RLKLLNKYLKKLKTEQARRRVALEK

SEQ ID NO: 7216 - protein, 48 aa, synthetic construct
FIKLFQKWLKKFRSKLMAYMLWTMIVRLARRLLLNPAKAFKSKTRDKR

SEQ ID NO: 7217 - protein, 64 aa, synthetic construct
KFRLFRKIFRFLQHLEERAMRKGRLKLLQKLLAGRKYAPQQKKWGCKHIRRVAILRRGDALAQR

SEQ ID NO: 7218 - protein, 43 aa, synthetic construct
YIKLFKRFMRRMRCLRARKALWSKIILLDRAEAKKALKAKVDS

SEQ ID NO: 7219 - protein, 23 aa, synthetic construct
YYRYFKKMLRYLRSARNKMFLAA

SEQ ID NO: 7220 - protein, 44 aa, synthetic construct
ILRILTKWMRKLTSFAYLPKLRKHAIAPRRATREPTLWRALMRA

SEQ ID NO: 7221 - protein, 47 aa, synthetic construct
KIRFMSRLLKRWNPNWYRLWFEARLRMMAAYRMCAARVLHKLRKDKL

SEQ ID NO: 7222 - protein, 38 aa, synthetic construct
KFKMLKRLLKWMRHFKAKYLKCFCLGAAECAFRLRVER

SEQ ID NO: 7223 - protein, 74 aa, synthetic construct
FLRFMPKMLKKYNRLRLQICRGRNIDLCKGSDKSRLNCYCKHSYKLRALQAKCKNAGLAARTLLKKLRTAERLK

SEQ ID NO: 7224 - protein, 76 aa, synthetic construct
YWKLIKKFLRKITKRLKLTNKRALLAKRKKFWERHTTRWLHLQKRRRVLKGAYFKWQATAAQWCNQKEAAISGARL

SEQ ID NO: 7225 - protein, 28 aa, synthetic construct
WLRLIRKLLKFLTKKLYLKLMRCTRLRY

SEQ ID NO: 7226 - protein, 56 aa, synthetic construct
RYRMLRKIFKKLRHRFAQKLHLLALVKPAEARHTREADWRLKQTHRRTRAHKLADI

SEQ ID NO: 7227 - protein, 29 aa, synthetic construct
RIKLLKRLMKLFKCKLKQLKLKGCRAILM

SEQ ID NO: 7228 - protein, 22 aa, synthetic construct
KWKLFHRLYRKWRKELAFAMKL

SEQ ID NO: 7229 - protein, 30 aa, synthetic construct
KMRFLRRLLRWWNRCVSVVQANLNALAARK

SEQ ID NO: 7230 - protein, 41 aa, synthetic construct
RFRYWTKIMKRYRKARIAMKLRLLYKLRQLAAQLALHIALP

SEQ ID NO: 7231 - protein, 64 aa, synthetic construct
RIRLIRKWFRKWSKDKRSTATPAKRSPVARVLAQKLYKLRSSKRLARHLLGALLRYGKFFRQNL

SEQ ID NO: 7232 - protein, 22 aa, synthetic construct
RLKMFKRLMRKIQNLALKALRR

SEQ ID NO: 7233 - protein, 20 aa, synthetic construct
FWRYLRKILKKFSQKTLAGA

SEQ ID NO: 7234 - protein, 41 aa, synthetic construct
LYRILRRFFKRWCQGKDLNKDRVARLNKGGLLSATAALMLR

SEQ ID NO: 7235 - protein, 69 aa, synthetic construct
LYKMIRRMLKKLCKLMRCVGCKRAKRRQSAYDFALGYKKRARIRNIRWLLFLLAWGLQRRLSKQVALGK

SEQ ID NO: 7236 - protein, 41 aa, synthetic construct
YLKMLRKFLKRLPKLSKLRNAMVAELRHQPTAPRGLELRTL

SEQ ID NO: 7237 - protein, 63 aa, synthetic construct
RLKLLPRLFKWLKRLQMFYIKKEHKCYLAYNLAVKQMCKQAALVGFKVLKRLAKKMMLLDFGR

SEQ ID NO: 7238 - protein, 49 aa, synthetic construct
RFKLMRRILRRLRCRRHKAKGLWFSLAFNAVVDDAFPRAAAALRLKRCW

SEQ ID NO: 7239 - protein, 50 aa, synthetic construct
LYKLLCRLWRRIRKKAPMAVLSSIQLHYKKAKRMDSKRDLAFGLANLRYA

SEQ ID NO: 7240 - protein, 42 aa, synthetic construct
RLKWFRRLLKILKRRYAVKLAALKNLAKLISVCRKYRDAALN

SEQ ID NO: 7241 - protein, 42 aa, synthetic construct
KLKLLKRFLKRWCRIKYEIWARKDTLRDSTPRLKALVCLKSL

SEQ ID NO: 7242 - protein, 42 aa, synthetic construct
KLKIIPRLLRLIRKLNPKGNRIGKLLLKVKAQYFRWAVLLQK

SEQ ID NO: 7243 - protein, 58 aa, synthetic construct
LWKFYNKLLRRFKRGACFRQGRPLRSDKRMVSMVYSRAKARKAAQRCARRAALWDKNA

SEQ ID NO: 7244 - protein, 24 aa, synthetic construct
LIKLWHKLIKKFKKNDLGRLKSAD

SEQ ID NO: 7245 - protein, 37 aa, synthetic construct
FWRFWRRLLKFMNRRRCARSALQLKLNMWLLAAPRAR

SEQ ID NO: 7246 - protein, 93 aa, synthetic construct
KMKLLRKLLRMLRREKVLMDGSKFIQRRLKPLEIARAHKICDKRLIRLHKRTRSALAHLNYALWKKIARFKQFRVFAAKLRNVRKVMIRKVMP

SEQ ID NO: 7247 - protein, 28 aa, synthetic construct
RMKFLRRLLKKLQKFQFSMNRAYAESKL

SEQ ID NO: 7248 - protein, 50 aa, synthetic construct
KMKFWRKYLRMWKRLQLFFPAIRFLLCRLFMLASAPKPRRDKKASHLTAR

SEQ ID NO: 7249 - protein, 69 aa, synthetic construct
KWRLLKKFFKMLCKKMTLAILKKTRSVAYLRAYILLDCRIRQWAAKLNKALQLNFAELSKAIAKRHAAQ

SEQ ID NO: 7250 - protein, 66 aa, synthetic construct
RMRMLTKFFKKIKKDLRILVALHRFLWDLRLKARRQDRLGGRGYAARKCRLLLQLAKWFCAKAKTK

SEQ ID NO: 7251 - protein, 24 aa, synthetic construct
RLRYFRKMLKWLKHATEASYKAPR

SEQ ID NO: 7252 - protein, 63 aa, synthetic construct
FYRLMSKMFRRWKRLRLAMADKAPPVRQRKRIGCAQYWLLHAKRGKRAHALTALDGRRPKLWL

SEQ ID NO: 7253 - protein, 23 aa, synthetic construct
FFRWLKKMLKKYKKYLLYGQNLL

SEQ ID NO: 7254 - protein, 21 aa, synthetic construct
MLRMFPRLMKLLPRAHRRKKL

SEQ ID NO: 7255 - protein, 33 aa, synthetic construct
KIRIWQRLLKKFKSNMNRLDAKLSLLKSELARR

SEQ ID NO: 7256 - protein, 56 aa, synthetic construct
FFRLLKKMFRLWQRRKLRQRWKTLFASSAWRARKNDMNLAYKRAIRLELKKWQLWN

SEQ ID NO: 7257 - protein, 39 aa, synthetic construct
LLRWYRKYFKIFKTALYSKHRISLRTELALALLLLIRDK

SEQ ID NO: 7258 - protein, 57 aa, synthetic construct
FLKMFKKFLKLMPSKKTVAEPLKNSCRWARRSMKAKARRKLACYNAALKLPFLLRNQ

SEQ ID NO: 7259 - protein, 31 aa, synthetic construct
YLKLLQKFYRKIRPNRFKKAKRMIALVLRLL

SEQ ID NO: 7260 - protein, 56 aa, synthetic construct
FLKFFRKMYRKLHKRDIKKANRTWLKKLAALARYAAWFNLIAVRLPKAERGRRQAK

SEQ ID NO: 7261 - protein, 60 aa, synthetic construct
RYKWYQKYFRWFRQTADRMGALLTNKFRMKDTALASRWVKALLGVEKKRALKKGKLLCRL

SEQ ID NO: 7262 - protein, 25 aa, synthetic construct
KIRLLRRLLKRMHTLTAVPLKKMLA

SEQ ID NO: 7263 - protein, 35 aa, synthetic construct
RFKMLNKWLKKLRPLLLANAKMGWKNYACFRKAGS

SEQ ID NO: 7264 - protein, 45 aa, synthetic construct
RLKYFCRLYRKWKRAAAAAVDHMFVKRTRCRTILATPANRLIRRE

SEQ ID NO: 7265 - protein, 62 aa, synthetic construct
RIRLLPKLWKRIPRSEKRLDNCALLLALLALQPDPHTPLRPLLALRPKHGVRLLRKDMTRAI

SEQ ID NO: 7266 - protein, 100 aa, synthetic construct
KFKYISKMYRLYPRLYRLLLHLKDRALLNTPTKRYCRLLRDRLKKKKKALALANKKLRARKLWKRWGNFDARGLTYPKRWTNLSKSEHTWQFHMAREIKL

SEQ ID NO: 7267 - protein, 24 aa, synthetic construct
RLRLYSKFLKLFKHKLMKKHKNLA

SEQ ID NO: 7268 - protein, 25 aa, synthetic construct
LYKLFRRFLKWYRCRELGRAKAVYQ

SEQ ID NO: 7269 - protein, 42 aa, synthetic construct
YWRFLRKYWKKFRTLILTTNWRLKSAAKYARRMKYILKIALA

SEQ ID NO: 7270 - protein, 22 aa, synthetic construct
RLKLLKRLYRKLKSLSRQAVYV

SEQ ID NO: 7271 - protein, 33 aa, synthetic construct
RLKYLNKWFRKFKKAKLQALFAPMILLKRAMQQ

SEQ ID NO: 7272 - protein, 32 aa, synthetic construct
LLRLWKRMWRYLRCCLKLHSLRAAKACTILTR

SEQ ID NO: 7273 - protein, 63 aa, synthetic construct
LYKIWCRFLKFLKRRSRRRLRPYMKLAKAESYKGRAAMFKEAAMKAVCRCRAINKFLIAWLDD

SEQ ID NO: 7274 - protein, 53 aa, synthetic construct
RLRWYRRLLKRYKQAVKQYRLRCEKAEAKEYLTLCLAYSQRRFKMHRDAYAAE

SEQ ID NO: 7275 - protein, 60 aa, synthetic construct
LWKLWKRYLKRFNKEEMLAPSFRMKQRGREKLRPSLPRHLKLSKKKLSGAFDRLCAAKEK

SEQ ID NO: 7276 - protein, 42 aa, synthetic construct
RFKIWRKFWRFYRKWKQRKYHLALHARLNLYQAQLRRAAKPN

SEQ ID NO: 7277 - protein, 94 aa, synthetic construct
RYRLMHRFLKFLSSRQAYDWASRQPKIFMWALRRALNRQELTWSKMNKALKRAKLAFLLFELKRRPGVRARRLQGHAKRKLIVKRLEAPHRVKK

SEQ ID NO: 7278 - protein, 34 aa, synthetic construct
LFKWIQRLWRKLRRHRACEWAKREQANALPAAAM

SEQ ID NO: 7279 - protein, 24 aa, synthetic construct
KWKLLNRMMKKLSRADGAVFLKKL

SEQ ID NO: 7280 - protein, 29 aa, synthetic construct
RLRLLRKFFRRLCKRDWRWAFCALRCLLH

SEQ ID NO: 7281 - protein, 41 aa, synthetic construct
RYRMLRKYLRWFKTDFVRLKCPQAKMLLRGWRRLARLALLN

SEQ ID NO: 7282 - protein, 32 aa, synthetic construct
KLKLWRKLYRLFKHGLGLRLKTKLTWLKSERF

SEQ ID NO: 7283 - protein, 43 aa, synthetic construct
RLRLFKKLYKLWKCARKWKKNFTARQLGAFLKVRDMACRCAKV

SEQ ID NO: 7284 - protein, 30 aa, synthetic construct
RYRFFQRLWKRFRKAPLLDCRLRGAADIDL

SEQ ID NO: 7285 - protein, 63 aa, synthetic construct
YLKYLSRIYKLLHKPAKTEKALMSALLILQRSHSKCKLRHHARLRRAKGGFKLALGIAIKRQI

SEQ ID NO: 7286 - protein, 33 aa, synthetic construct
KLRYLKRLMRWYKKCGKAVLNLELYLRDLAMKS

SEQ ID NO: 7287 - protein, 23 aa, synthetic construct
KLKLLKKMFRWFRCLKELALLRG

SEQ ID NO: 7288 - protein, 39 aa, synthetic construct
RFKWFRKFLRRLRHMLFHPASSATRLWAFAAMLKKFPAL

SEQ ID NO: 7289 - protein, 24 aa, synthetic construct
LLRFMRRFMKKLQQLKAIAQRKFH

SEQ ID NO: 7290 - protein, 28 aa, synthetic construct
MLKFYRKLLKRMTKAANKANVAMKTELQ

SEQ ID NO: 7291 - protein, 39 aa, synthetic construct
WWRFLKRLLKFFKKKKCVLALKKKYNAFDVAKLQANFSL

SEQ ID NO: 7292 - protein, 47 aa, synthetic construct
RIKWYKRLLKYLRKAQRDKKQFWRAFWWRLRLRLLKLAVRPDLVWRL

SEQ ID NO: 7293 - protein, 22 aa, synthetic construct
RMRLLRKFMKMFKHLQALQKAK

SEQ ID NO: 7294 - protein, 23 aa, synthetic construct
KFRLLKKLWRLFNKKLWQLKRQA

SEQ ID NO: 7295 - protein, 71 aa, synthetic construct
LMKWWNKLMRKLPNKDELDPGRAPARLPRTRTAARKLRKFKLNAKKLLVIAGTALPCKDCLDETVAAWRAR

SEQ ID NO: 7296 - protein, 36 aa, synthetic construct
LLRFLRKLLRYLKRKWKELDMHELNKCAHHRNRSKQ

SEQ ID NO: 7297 - protein, 90 aa, synthetic construct
RWRLFRKFLKFMPNALRKEEMHKTCDKRYAAAAHPKIAWVKAATLLIYKAAKLGANPAGKLSWSHIKMHFKKLRLNAKRAIAFALERLAE

SEQ ID NO: 7298 - protein, 41 aa, synthetic construct
KYRMMQRLWKWYRRLKRRIAELACKRAFAKILMILLLIVYD

SEQ ID NO: 7299 - protein, 27 aa, synthetic construct
LMRLWTRWIKKLKRRIFRAAALARAWP

SEQ ID NO: 7300 - protein, 22 aa, synthetic construct
LWRFYRRYFKLLRPLLRKRLLM

SEQ ID NO: 7301 - protein, 31 aa, synthetic construct
LLRLFKKLYRKFKRLSESDCVVYFAAIKLLK

SEQ ID NO: 7302 - protein, 21 aa, synthetic construct
FLKLLHRLMKKFRKKVKLDIA

SEQ ID NO: 7303 - protein, 91 aa, synthetic construct
RLRWIRKLFRRYSRNNHMEHCESMNLENSIKLKIRAWANRRSVKRLKALKLAPALKKHLARRIAHRNGRFQISPALTMRAALKKALARCGL

SEQ ID NO: 7304 - protein, 77 aa, synthetic construct
RFKIFKKLWRFLRKWQGHVRLKLALLKADSFGMGARLRLDRQTFGFYRGGWRAKKEQALQKARTCEARYALRKQAKL

SEQ ID NO: 7305 - protein, 29 aa, synthetic construct
RLKWLCKIIKKFKKCSAAPHLDLKLRLAR

SEQ ID NO: 7306 - protein, 46 aa, synthetic construct
MFRLFKKFIKLLKCWKAKTYGKHAKLVRLKRLKILSSCCKNASAIA

SEQ ID NO: 7307 - protein, 86 aa, synthetic construct
RIKLYKRFWRKWKQKRSSSPLLDIAWLLCRMRVGCMLYATYAKAKMAKLDAQWLRNFMRLKGWNLFCKTAKTRKLLRGVAKKALLK

SEQ ID NO: 7308 - protein, 23 aa, synthetic construct
KFRWLKRWLRYLRKKAARAKLML

SEQ ID NO: 7309 - protein, 20 aa, synthetic construct
ILRLFRRLLRWFPKIRRAFA

SEQ ID NO: 7310 - protein, 40 aa, synthetic construct
KLKLLRRLLKFLCKLYCKQSRYTRNHALLRLASFAAKENL

SEQ ID NO: 7311 - protein, 65 aa, synthetic construct
WLKLLRRLFRKWRPCPRYRSLTKAGKACAACLLKAKVLLPAQYCRFGPFRMAHRIKKGKGVMDAK

SEQ ID NO: 7312 - protein, 28 aa, synthetic construct
RMRLIKKLWRRFSKDAPGRLCMAARFAW

SEQ ID NO: 7313 - protein, 62 aa, synthetic construct
KLRFLQKFLRRIRRSNLALIAGEDRSPLRRLRLFKRNLACHAGGKLAQGRGAATKARKFLLL

SEQ ID NO: 7314 - protein, 26 aa, synthetic construct
LIKFLHKMIRRLKTAKKPAWVLATYA

SEQ ID NO: 7315 - protein, 29 aa, synthetic construct
RYKLLKKMMRRFKTLYCALAKLMRWAKAR

SEQ ID NO: 7316 - protein, 38 aa, synthetic construct
LYRFLRKLMRRLHKSWRDRFYYARMRHKRAMALLMLDA

SEQ ID NO: 7317 - protein, 81 aa, synthetic construct
YMRLFQRLWRLFTHRKKIAIEYAAYFWCAKKKCARIDRKSEKHKRKRLLWRTWKLRFRSACLACRLRAKPWCMLLALIRVG

SEQ ID NO: 7318 - protein, 36 aa, synthetic construct
KLKFFSKILKLLKKHKLADNRHLWKYILRPALKAAA

SEQ ID NO: 7319 - protein, 30 aa, synthetic construct
RWKIWTKLMKWLKKRNAAESRREWQLWRAL

SEQ ID NO: 7320 - protein, 49 aa, synthetic construct
KLKWFKRIFKLFKKVAARLQKLQLLKAKQDKKKQICQWEPLQALLDAAY

SEQ ID NO: 7321 - protein, 56 aa, synthetic construct
RLKLFRRLFKLMQKDKIADHMLLFLAFNKPHLKRCSALRKGCVLRSLRLQMRAEKI

SEQ ID NO: 7322 - protein, 32 aa, synthetic construct
KYRFIRRLLRFFRKKWLFALARSACALKTAAQ

SEQ ID NO: 7323 - protein, 44 aa, synthetic construct
YIKFYCKFYKKMKREKEGALDLLAAAGYKKRRFAVAAKPPKLLG

SEQ ID NO: 7324 - protein, 20 aa, synthetic construct
RFRLLPKILRFLSCLQREQR

SEQ ID NO: 7325 - protein, 43 aa, synthetic construct
KLRYLQRLLRKWKKSETAASKAISCALAEPLFWEKVARLKRLR

SEQ ID NO: 7326 - protein, 45 aa, synthetic construct
RFKYMKKLWRLLTPLTRSLATLKPLSAYAYKRLNSKAARLGAKWL

SEQ ID NO: 7327 - protein, 40 aa, synthetic construct
LLKIFPKMIRRLKRTKNYMWKHARLAALLQSKDDAAKQVG

SEQ ID NO: 7328 - protein, 34 aa, synthetic construct
KLKYFRKFLRKLKCTLAAEIAIELRLAKRHKTAY

SEQ ID NO: 7329 - protein, 41 aa, synthetic construct
KFKFLSKLLRKMPKQLLRCPKKLNCRELQIIRSCLLLKLHC

SEQ ID NO: 7330 - protein, 45 aa, synthetic construct
RFKFYKKLWKRWRSLPALACPHKRSGLRRHTWLRKAAKFMAARAW

SEQ ID NO: 7331 - protein, 78 aa, synthetic construct
LWRFFRRLLRIMKRSQAAARLAHRKKPAAGLDLKRCYQAQIAVWALAIKISAPAMSEHEKYLRYLAHRQEMHRRNLKA

SEQ ID NO: 7332 - protein, 30 aa, synthetic construct
RLRFLRKFWRIYRHKTRRCLWRLLVQPAAG

SEQ ID NO: 7333 - protein, 50 aa, synthetic construct
LFRYIRKIWRKYRHPKLVRAKLWTRLRYNTPMALMKAKSRAPLHARWLRD

SEQ ID NO: 7334 - protein, 33 aa, synthetic construct
KLKLLKKYLRRFKRCRKANYAMAARHCIMADVR

SEQ ID NO: 7335 - protein, 65 aa, synthetic construct
LLKILHKLYKKLPSSDLCALARSFRSKPIAVHRAERMKHRWMRADKLVCLKKIWQKAKARAKFLW

SEQ ID NO: 7336 - protein, 96 aa, synthetic construct
FLKYMHKLLRKLRRAHLARVKALHTVALVKLCAAKKSLEKDGQLLKLKRETIAKNQQAWRQDAACAHFTVWLLKHLGRRRAMYMARAAMIRWLQRR

SEQ ID NO: 7337 - protein, 38 aa, synthetic construct
KLRLYSKLLRFIKRLAAEHYKLAFNRVKRRVAHQFMRN

SEQ ID NO: 7338 - protein, 54 aa, synthetic construct
LIKLMRRYLRMLTKAGATEARLKEQLATAGRKELAKNDKDLRLKAGAGTTKGLN

SEQ ID NO: 7339 - protein, 28 aa, synthetic construct
RLKLFRKWLRRYKTKCLAALLFRFHHWL

SEQ ID NO: 7340 - protein, 24 aa, synthetic construct
IYRLMRKILKKLRRWLRLLVSAER

SEQ ID NO: 7341 - protein, 65 aa, synthetic construct
IMKYLSRMWRFFRSLLPLRHGAIRAIRHQNRAPRSLKAKARKKAKRALTAEKLIFRVLELKPTSE

SEQ ID NO: 7342 - protein, 40 aa, synthetic construct
RWRLLHKLMKKIRKKKIGLHEPPHAFHKKARWANQRLSEL

SEQ ID NO: 7343 - protein, 42 aa, synthetic construct
KMKWLRRMLRFFRCRELKKPAGRRERLRLADDCLKMPNLAMA

SEQ ID NO: 7344 - protein, 36 aa, synthetic construct
KLKLLNRILRIFRKHWACQLKMKMRELRLGKIAHTD

SEQ ID NO: 7345 - protein, 73 aa, synthetic construct
YMRFIRRFFRKFHKLKGEFAKADARLLKQVVAFATDRRAKKGLGARQCLSLKRLKRLALDAALPCQLFAWLYA

SEQ ID NO: 7346 - protein, 72 aa, synthetic construct
KWRWWKRYYRLMSKRYKLVLARPRLCSHKISQLDDRALFTLRRHAALCRRKVLILDCRQWKKKPRRLIHLLR

SEQ ID NO: 7347 - protein, 43 aa, synthetic construct
KLKFFCRLYKKIRNIAVVLWLRRLFVLRKALTQTPRLYGLLIR

SEQ ID NO: 7348 - protein, 20 aa, synthetic construct
RLKLLHRLLKYLRCFNGACG

SEQ ID NO: 7349 - protein, 21 aa, synthetic construct
WLKFLRKLFRFLKKKSAKAVC

SEQ ID NO: 7350 - protein, 21 aa, synthetic construct
KLKFLHRLMKKYSKAHAEREQ

SEQ ID NO: 7351 - protein, 23 aa, synthetic construct
FLKFLKRLWKRFNRAKWKEAWCA

SEQ ID NO: 7352 - protein, 31 aa, synthetic construct
RIRLFHKLLRFYKQLLAERSLIGLKALSQIR

SEQ ID NO: 7353 - protein, 48 aa, synthetic construct
KIRLMKKLLKMFKPAYVKLLPAEQIAAKLVAKRKIQDKAGQFRLFAKQ

SEQ ID NO: 7354 - protein, 71 aa, synthetic construct
YIKYFRKLFKKYKSLCLRDMMKRWRLEAECGRAYYRKKNLLVRQAAPFAAKEKNREYAADAMRYAKPLLAA

SEQ ID NO: 7355 - protein, 40 aa, synthetic construct
FLKLWNRFLRKLKRMDREDLLRRMKRLNDIILGQPIQARR

SEQ ID NO: 7356 - protein, 20 aa, synthetic construct
KIKLLQRLLKRMTCLSPARW

SEQ ID NO: 7357 - protein, 52 aa, synthetic construct
KLKLFRRFLKFFKPGLLAFTVFWFLAKSSYAAARALRRHWGIAKKRDRRGAK

SEQ ID NO: 7358 - protein, 36 aa, synthetic construct
KWKILQRIFKKLRHLYTTASRAMLLEKALKLAWPTA

SEQ ID NO: 7359 - protein, 46 aa, synthetic construct
KLKFLSKYWKRFRKKLLILAYRKQDRANKTTWHKLERVTPAAAKNV

SEQ ID NO: 7360 - protein, 21 aa, synthetic construct
LYRMLHRLFRLLKRQKTLARC

SEQ ID NO: 7361 - protein, 44 aa, synthetic construct
IFKFICRLLRKIKRDALRMTRRRWLALSLLLKRLDAACLHVGPS

SEQ ID NO: 7362 - protein, 25 aa, synthetic construct
RMKMYKKLYKKLKRLKHEASFLLLT

SEQ ID NO: 7363 - protein, 24 aa, synthetic construct
IFRLITRWLKKFRRCIQQLLLLKR

SEQ ID NO: 7364 - protein, 49 aa, synthetic construct
FLRWLSKLFKRLHRSPMRHRIALEAARMAPRAVNLAKAHYWKKRLIHDA

SEQ ID NO: 7365 - protein, 24 aa, synthetic construct
LMRLFKKILRILKRLNRLCNCKLK

SEQ ID NO: 7366 - protein, 57 aa, synthetic construct
LLRIWRKIFRKWQKDCLHPRAIIAHRKKDKSLTKLIKVAARQNAACFARLMRKCVRA

SEQ ID NO: 7367 - protein, 45 aa, synthetic construct
WLKLFKRFMKFLSKRKLGGASARRRAARAVRAMACLKDDGLLGGK

SEQ ID NO: 7368 - protein, 56 aa, synthetic construct
KLRFFKRWFRLWRRSLAKGALKRLWSLTRMCAKSPLVMEAKDIVCARGKQRPARPR

SEQ ID NO: 7369 - protein, 92 aa, synthetic construct
KFKFWRKYLRKLSKLYKNLAKNLDWRAMSPKSMKKTYKALAIMTLNRRSWLKLRLYWWQARRTAKRYRAARTKKKLRALLKLNLMRCLKEPM

SEQ ID NO: 7370 - protein, 58 aa, synthetic construct
KLRLICRLLKFFNKLAYKKLPKGRELLLCCMCLWLKIANYRKNLDALQRFRRNKRMRS

SEQ ID NO: 7371 - protein, 80 aa, synthetic construct
KMKYWKKLLKKYPSCLKEAGAKTKAEPAMALLNLLMRKKQCKLKKKLTLTAFLWSLVKLIKMTYVRMKAFRAKRISSKKK

SEQ ID NO: 7372 - protein, 41 aa, synthetic construct
MLKWLHRLLRMMPSADGKPLKLAQCRLNRRLRLIEQNELKA

SEQ ID NO: 7373 - protein, 94 aa, synthetic construct
RLKMLRKFMRRLKKSTLKTALLKLEALKKKFLRMKAWHIRLLALLCRRRMMEGYVALHYAPSLKDMDDIKNLEKGLADKLAYESELWHLKWVQL

SEQ ID NO: 7374 - protein, 26 aa, synthetic construct
RMKWLKKWLRKLRQYQRPGLAAAIEP

SEQ ID NO: 7375 - protein, 25 aa, synthetic construct
LIRWLRKMYRILQTLIARKAERRYA

SEQ ID NO: 7376 - protein, 34 aa, synthetic construct
LLRMMQRLIKKFHRNTKACDAGDLAFKSALCRLL

SEQ ID NO: 7377 - protein, 73 aa, synthetic construct
MFKWYRKFLRRIKSWQVSRLMNRAFTMAALMAFAARMFRNRYLAAKQMRPKFRNQHAASRAKWNRRLARRAKA

SEQ ID NO: 7378 - protein, 55 aa, synthetic construct
KWRLIRKLLRFIKTVWADKDLLEKLRLDKSYLTARLFALLALMASDLKKSPPQTT

SEQ ID NO: 7379 - protein, 23 aa, synthetic construct
KLRYLKKLFRKYSKELTSQNILL

SEQ ID NO: 7380 - protein, 32 aa, synthetic construct
RLRLFHRYFKKLRCRFKTIERARLAAWAWYLH

SEQ ID NO: 7381 - protein, 74 aa, synthetic construct
RFKMLNKLFRWLTKASACSHRIKNGQLRALKIWKELRFRLHLLKLQMTAKVVRLFGAARPKSFAEKAKYRFKKR

SEQ ID NO: 7382 - protein, 99 aa, synthetic construct
RLRLFCKFMKRWKKLKKRRRKRLYCQALWATLRCDAYLKALWNKLTDSRIRYLRILMRRTLIAALSDWIRPKWLRAHGLRWLRASWLHNWIFKERATGL

SEQ ID NO: 7383 - protein, 41 aa, synthetic construct
RFRMMSKYFKYFKKDLRLLKAFLLARRLTRAVRELAQEKAY

SEQ ID NO: 7384 - protein, 28 aa, synthetic construct
WLRLIRKFLKIYRPNCSLKAAPRNWKAA

SEQ ID NO: 7385 - protein, 67 aa, synthetic construct
KMRYLKKLLKKWPKRLSSALKAARCLQIRHVKRAFAVPKNRAFGLGQKADKQRGDAILKLILLRKAA

SEQ ID NO: 7386 - protein, 60 aa, synthetic construct
LLKIFRRIMRKFQRAVYKRTIFQRPLWRHLLFKCSQADLRRLRELLTLRYLQYAKVPLAR

SEQ ID NO: 7387 - protein, 53 aa, synthetic construct
IYKFLKRLWRKLRRLLLHIAAKHCEKLKIGNRSYPRLECKPVLKLRYTRLTGL

SEQ ID NO: 7388 - protein, 79 aa, synthetic construct
RLKLIKRIFRWMRKTQQWFTIKKIALLSAFSKLRYKWRYFKCALTRLKLKLLANRDATRGRLAALLIYLLRVKQILTYW

SEQ ID NO: 7389 - protein, 41 aa, synthetic construct
RIRFMRRLFRRMKPLMTKHKLLHLKVTSAALEARPLVGIAA

SEQ ID NO: 7390 - protein, 42 aa, synthetic construct
MWKILKKLMRRYTKALVALPAKKHLFQGRKDALHLQLCKHAS

SEQ ID NO: 7391 - protein, 83 aa, synthetic construct
RMRFLNRFIKKMCQKLARFTRLRSALAFKNAGRRSRTFLYRRIWLQHALLKNLCRDRLLARGTRRKNALLRSDKDKCECAAYS

SEQ ID NO: 7392 - protein, 28 aa, synthetic construct
LLKMLRKLMRFIRQAEAFLKVSAKAKQK

SEQ ID NO: 7393 - protein, 52 aa, synthetic construct
RYKWFQKIFKRWKNRFRYKHNLDLLKEHKRAAIAQALLFRCPSLKAAEKALR

SEQ ID NO: 7394 - protein, 32 aa, synthetic construct
FFRILKRWLKWLQKLVLCAKRARSRQSILFRI

SEQ ID NO: 7395 - protein, 70 aa, synthetic construct
RIRYLRRLIKKFRSMLNLAMAVRRASLFHYRYARLATQAFLANLALGKKRIWAKEKKCKTSRWAMMRGTK

SEQ ID NO: 7396 - protein, 64 aa, synthetic construct
FLKYIRRYFKRLRRAANALALSANLAARKKRPTAPKIYAKERYNDAKKTARIQFLCRMKKCEFT

SEQ ID NO: 7397 - protein, 30 aa, synthetic construct
YLRLMKKLMRRYKKIKELLNFAADAVLNAL

SEQ ID NO: 7398 - protein, 55 aa, synthetic construct
RYKILPRLFRKFSRHFRGLAFAYRAKAAYLEKLKAREAARDGDIAKFKPRMTRKE

SEQ ID NO: 7399 - protein, 77 aa, synthetic construct
KFKLMSRIFRKIQRYRQGRKTRRLKLAGMQSLRAVLARRPLHLVEFGAKFRAMACHVRPLSRRRGAEKCAEAKLRFL

SEQ ID NO: 7400 - protein, 50 aa, synthetic construct
YIRYLKRLLKKLKNANQEPTAAKLPKARWLKDARAKMYPEMTRRRTAPDR

SEQ ID NO: 7401 - protein, 40 aa, synthetic construct
WIKILHRLFKLLPSKERIALMILKSQYRKAIRWLKKAMAY

SEQ ID NO: 7402 - protein, 28 aa, synthetic construct
MIRLLRRLLKYYHRLGKARTFRLGKVGP

SEQ ID NO: 7403 - protein, 21 aa, synthetic construct
KFRIITKFLKKLRSLLLYIKD

SEQ ID NO: 7404 - protein, 61 aa, synthetic construct
IMKMLRRFFRIYKNAHRKAYKLWRLWKREDMRSNLTAVVKAALKRRLVLRITLAKATWTKP

SEQ ID NO: 7405 - protein, 20 aa, synthetic construct
LLKLIKKFYRFITREQMLRL

SEQ ID NO: 7406 - protein, 87 aa, synthetic construct
YFRIWRRWYRFYRKQGQLFKAAAHALKLLGMRMMAEAKKITLCKYFHRKRALWLLEKKAKYRLLWYSLKELGAKNAKLLTGKCMAPQ

SEQ ID NO: 7407 - protein, 33 aa, synthetic construct
MLRLLRRLLKKLTHLLIKRNKKDCRILRQRIYQ

SEQ ID NO: 7408 - protein, 41 aa, synthetic construct
LIRLYRRYFKRLKCRDDKAAVLVAPLLLLRARRYLAISKLV

SEQ ID NO: 7409 - protein, 59 aa, synthetic construct
RLKFLRRLLKIYRRLEACNFVAGARKKDLRTRGLIDARPSAAIALLATRYTCRQHFYRL

SEQ ID NO: 7410 - protein, 47 aa, synthetic construct
KLRFIKKIIRILRPRAMRARMLDLRGTARLNRERGQGKAAALHCYMD

SEQ ID NO: 7411 - protein, 22 aa, synthetic construct
YLKWLSKILRKLCRLFKLCSCR

SEQ ID NO: 7412 - protein, 100 aa, synthetic construct
KIRYMSKILRRISPHTCKSRKLGKLLTKHRKSRKRFKAAARLACYMADRAQHALCRCLFARWWKCIERKKALTAKKAKAIRAQKAARTFRLADREPLQAP

SEQ ID NO: 7413 - protein, 34 aa, synthetic construct
RMRFLQKFLKRYKRLYNFRTWKRLAWAKEAFGCA

SEQ ID NO: 7414 - protein, 78 aa, synthetic construct
KMKWLRKFFRRFRHACTLAKIKKDAAVRLRLWLLLAGFKQCALPIIMYARRRWKHAEWNEDRAKTGKGAKLLCIYRLE

SEQ ID NO: 7415 - protein, 23 aa, synthetic construct
RLRFLSKYYRLLTRALKARDTAV

SEQ ID NO: 7416 - protein, 27 aa, synthetic construct
MLKFLSRYYKWIKKLLWAARRAMKDVM

SEQ ID NO: 7417 - protein, 27 aa, synthetic construct
KFRWLKKMFKKLKHPPAALLLADFRGH

SEQ ID NO: 7418 - protein, 40 aa, synthetic construct
RWRWFKKLFKKLKKAYQADRLIAKMKLLYPAKAKQFRWAL

SEQ ID NO: 7419 - protein, 41 aa, synthetic construct
KLRLYSRLMRLWQRGNQSLARGAEKFRKAKSLDSLKIKGYA

SEQ ID NO: 7420 - protein, 71 aa, synthetic construct
RLKLLQRYLRLYRRTNLKFRMVTRRATNQVTVDAWAYNASKCKDHRAKLGQKAVAARRRKFRLKFLRFLPQ

SEQ ID NO: 7421 - protein, 22 aa, synthetic construct
RLKFFRKMLKKMSRAAYYKLAA

SEQ ID NO: 7422 - protein, 32 aa, synthetic construct
RMKFLHKFLRRLHRKKKALTSLRKYVAAESEW

SEQ ID NO: 7423 - protein, 23 aa, synthetic construct
LLRFFRKFFKKLKQAILCLKAKK

SEQ ID NO: 7424 - protein, 32 aa, synthetic construct
RFKLLKRFFRYLRKWLLPRQWIKFALKVRTEL

SEQ ID NO: 7425 - protein, 36 aa, synthetic construct
RYKLIHKYLRFLRKPDKLAKQAKLINMAFAALHQKR

SEQ ID NO: 7426 - protein, 44 aa, synthetic construct
RLKYYQRYMRRLCRRLRKHGNGRLQTAYHHMLRADKLLSASKAK

SEQ ID NO: 7427 - protein, 69 aa, synthetic construct
RFKFFKRLLRLLRTKPRATMNTDECVAAQLLAPKAPLLLKRRPKADFNCRDERFLTKALMPAWSNAAKP

SEQ ID NO: 7428 - protein, 51 aa, synthetic construct
FLRYLRKILKRFRKKAEIAYFSRTRCLTALKWRLYLTVACKMPRDARKAKK

SEQ ID NO: 7429 - protein, 32 aa, synthetic construct
KLRLYRKWLRLMHHYSRKLNNKTKLAVAAHIE

SEQ ID NO: 7430 - protein, 21 aa, synthetic construct
FFRLFHKLLKKLRRKCVALNH

SEQ ID NO: 7431 - protein, 51 aa, synthetic construct
RYKLFNRFYRFLRKKDGKLKITARAEVLRIDAKRGRTLLDKGKCFARALND

SEQ ID NO: 7432 - protein, 66 aa, synthetic construct
RLKMYRRFLRKMRRGLFVPAKADKNEWRRARAHLANLQMFKPKAACIDKMFAHLRPALGMIALAAI

SEQ ID NO: 7433 - protein, 57 aa, synthetic construct
RMRFMKKFLKRFRRLKKALLGAYTRQVLKAHMLKMTIDIARLKHVAKRDLSAARAAH

SEQ ID NO: 7434 - protein, 42 aa, synthetic construct
KYRFLKRLFRRLHHYYIALAAKETLTAKQLDPRALIDRAAPK

SEQ ID NO: 7435 - protein, 60 aa, synthetic construct
LFKLLNKILKKFCRSAAAAAKSYLYWKFPVQRILYRAWLLRRVKEFLWRMRLWLASRFKI

SEQ ID NO: 7436 - protein, 40 aa, synthetic construct
KLRWLNRLLRKMKRAKIMQWRALLAYICRLLDPRIAWYGL

SEQ ID NO: 7437 - protein, 95 aa, synthetic construct
KMKMITRFLRFLRRSLLLARTARFFEWKFYKTCLRKFARSLVAARASCTRAPRNNALNYCLRATRAACKRAIFRKIAARWVARRSELHRQLFWRY

SEQ ID NO: 7438 - protein, 22 aa, synthetic construct
ILRFLSKYYRKLRRKAADALYT

SEQ ID NO: 7439 - protein, 22 aa, synthetic construct
FLKFFTRFWRRIRRAAMAARLA

SEQ ID NO: 7440 - protein, 24 aa, synthetic construct
FLKFFPKLLKKLRKAASLVCGCKR

SEQ ID NO: 7441 - protein, 25 aa, synthetic construct
KLKILKKIYKFFPKLLTAKCSPLLM

SEQ ID NO: 7442 - protein, 40 aa, synthetic construct
RLRLINKILRMLKRLYAGQWLFLQCLHLRAKKCKEDARRR

SEQ ID NO: 7443 - protein, 58 aa, synthetic construct
KYKMYRKLFKYLKKKALLKKWRRRISDNSQVRLLAQYKHARCAWPLKTPRRLPLLAPR

SEQ ID NO: 7444 - protein, 35 aa, synthetic construct
RMKLICKLMRLFSKLARKKTLVQCNAKLKLAKAGK

SEQ ID NO: 7445 - protein, 48 aa, synthetic construct
LLRFLTRLYKRYKKFALAKPRKEKDHRKLELARVHHMFSAAAAVLIRQ

SEQ ID NO: 7446 - protein, 43 aa, synthetic construct
IMKLLQKLLKKINRIFISAKRQGKKARRMEVPAKQYKLRHAEL

SEQ ID NO: 7447 - protein, 54 aa, synthetic construct
KYKYYSRLLRMWRRLKKAPCWPRIMALRLKRTNLYRKAHPLAINEKKFLYELNR

SEQ ID NO: 7448 - protein, 20 aa, synthetic construct
YFRLFQRLFKRFKKAHMTLA

SEQ ID NO: 7449 - protein, 36 aa, synthetic construct
KFRFLKKLIKFMKRVKARQPKAAFFADFIATIAEKL

SEQ ID NO: 7450 - protein, 28 aa, synthetic construct
KFRMITRLLKFFKSLAAARDHRAFNANK

SEQ ID NO: 7451 - protein, 45 aa, synthetic construct
FMKLFCKILKLLKRNNLSHKFTKCRRRRANNKKCDQYVLLLKAQA

SEQ ID NO: 7452 - protein, 26 aa, synthetic construct
RWKFFRRMWKILSKKARLHLTDACAL

SEQ ID NO: 7453 - protein, 41 aa, synthetic construct
KLKLFKRFIKKICRRVCKCGRAALALYQELALTRRAYVGCS

SEQ ID NO: 7454 - protein, 25 aa, synthetic construct
YLKWLRRWLRWMNKNLLTMTRWKLR

SEQ ID NO: 7455 - protein, 25 aa, synthetic construct
KFRFYRRLYKRLNTNERMKQQALAL

SEQ ID NO: 7456 - protein, 64 aa, synthetic construct
KFRMIKKLFKLYKHTKLTLRRKLLARITWGRLELRCMEKEMPARAAWRASAKFFKKIYAKWQRA

SEQ ID NO: 7457 - protein, 66 aa, synthetic construct
KLRIYKRMFRRLQKVEKLLRKRLFRKKPRFAHPAARRGMKTLGFKKDVSLGMLLGGSLKELALLSL

SEQ ID NO: 7458 - protein, 85 aa, synthetic construct
RFKFLKKWLRRWRRRYLLSLACREIKVALRIDHKGLLHLCRQDTKVAKREAGVKRGELAPGATRQKNALGYAALKARSHKKAFKG

SEQ ID NO: 7459 - protein, 46 aa, synthetic construct
LMRMMKKLLRKWKRAARMACRTLRDRLIDSPDGLILHKLNAELIRS

SEQ ID NO: 7460 - protein, 41 aa, synthetic construct
LFKILCRLWKKFCKKLMLVLRLKPLARIVCFPLARQTNKDL

SEQ ID NO: 7461 - protein, 21 aa, synthetic construct
LFRFYNKLFKRLPKARRNAFE

SEQ ID NO: 7462 - protein, 49 aa, synthetic construct
FYKIFHKMLRLFRHELMPKRKGLLLKKLHPALKKLLLQHAYRKYLHNKV

SEQ ID NO: 7463 - protein, 48 aa, synthetic construct
LYKYIKRLWRKLKKAANAAFEACRWRLARLRRTKFQLATRLNILKHAI

SEQ ID NO: 7464 - protein, 38 aa, synthetic construct
IWRYYCRFLKKLRQAFFDLLVKRFAKRAQHGHLKEKAA

SEQ ID NO: 7465 - protein, 28 aa, synthetic construct
LLRMMRKYLRRLPKERAHMFRMEKLPAQ

SEQ ID NO: 7466 - protein, 51 aa, synthetic construct
FWKMWKRFLRWFKRAAALAKKKANAAAHGFMLKAACLIRLHRFRKLRQMME

SEQ ID NO: 7467 - protein, 60 aa, synthetic construct
RFKILRKLLRKWKPKWKAPAGTAAFIDAFAGAHKDLCRARSMIQHKAIIKARIGRLLAHD

SEQ ID NO: 7468 - protein, 32 aa, synthetic construct
KYRFLQRMFRRMCKAFKAILKKFAKQAKLLGI

SEQ ID NO: 7469 - protein, 68 aa, synthetic construct
LIRYFTRYYRKLKTKHYLRIRARALFAPPKVKNRCMKKQMCLYARLGRMQALLWALLRRRLPQYRAVF

SEQ ID NO: 7470 - protein, 56 aa, synthetic construct
RLKLMHKLMKKLRRLKRLILPQLRVTLLLFYRCLKHKRRTLLPRNRLHRAFNQMPA

SEQ ID NO: 7471 - protein, 71 aa, synthetic construct
KMRLYRRIWKKMQSKALLWVWNAWRVKVTAVPALRKAGQKKRKKKRAHMALLEHCALLRDKSLMTCRLKQS

SEQ ID NO: 7472 - protein, 29 aa, synthetic construct
RLRLLKRFLKRFNRAQFGAWTNATARFGA

SEQ ID NO: 7473 - protein, 74 aa, synthetic construct
RWKWLSRFMKYIKCLKLHGAQYKWGASAYKLLLKKAWAPQYRQLKIACRGVARRIKMLRMRLLLAGYRLERYRP

SEQ ID NO: 7474 - protein, 45 aa, synthetic construct
RFKLFKRFLRWLKKRLSLKRKKIMLPTLHRDHLVLHKYNLVSDLF

SEQ ID NO: 7475 - protein, 77 aa, synthetic construct
RWKWYKKLLRKLKPCLLCTNARSRDRRRIDARKLCRRILKLCATLVKLDQKRWNIYHLANPKPKLARAWKLFFAAMA

SEQ ID NO: 7476 - protein, 24 aa, synthetic construct
LFKMLNKFMRKLRPARAKIRLILR

SEQ ID NO: 7477 - protein, 32 aa, synthetic construct
RFKLFHKLLKFMSRRHEVKLYRKLDEAQAIAR

SEQ ID NO: 7478 - protein, 47 aa, synthetic construct
KIRWYKRFLRYFKKRLAAALQYRDKSPDILDFRSAKVRAALQGKSLQ

SEQ ID NO: 7479 - protein, 96 aa, synthetic construct
RYRLYNRLIRRIKKQHNKADKTNGLAGWRPKFLRSKFAIAARLVIDLAAGKWRLCITERKSWLFKASMLRKAKTLLRVRHKRRPRVLKTKKMQYAG

SEQ ID NO: 7480 - protein, 53 aa, synthetic construct
LLRLYRKFFKMMRCHKAKAWSLQLTDCQYANRRAHQRACEKLQGKLKKLRFRA

SEQ ID NO: 7481 - protein, 24 aa, synthetic construct
MLRLLNKILRRIKCRGAIQLRQNK

SEQ ID NO: 7482 - protein, 27 aa, synthetic construct
FLRWIPRLFRRLRKADDQLFMYARMAL

SEQ ID NO: 7483 - protein, 61 aa, synthetic construct
WFKMLHRLLRKIRKKLACLFALGRMPQLRLARTWATDFHVDAAIPKRKAYRLVWEKLKETL

SEQ ID NO: 7484 - protein, 34 aa, synthetic construct
RMRILTRFFKKLRKLLRLKGGHLCPLRAWDVDVL

SEQ ID NO: 7485 - protein, 60 aa, synthetic construct
LLKLLQRYMRKWCQYRLCFSKVAACAIRLLMFRKANKLTVKHCKILHLWELLRLKQERRM

SEQ ID NO: 7486 - protein, 22 aa, synthetic construct
LFRLLKKYFKRYRPARWLTVEA

SEQ ID NO: 7487 - protein, 25 aa, synthetic construct
RLKWLHRLFKKLTTWPLKRLCHLNK

SEQ ID NO: 7488 - protein, 20 aa, synthetic construct
LIRWLPRWLRYWRKRSLAYW

SEQ ID NO: 7489 - protein, 32 aa, synthetic construct
KLRFLPRFIKKMRRMQLGREAKFRMLAKLLFV

SEQ ID NO: 7490 - protein, 58 aa, synthetic construct
RYKLYKKLLRLLRSEDLLEILQKHTKLGKKARGAVANIPRTPKRAVKQHHKLLWAINA

SEQ ID NO: 7491 - protein, 98 aa, synthetic construct
RFRFISRLWKWIKRLANWLLKGGPAVRWLKVATMVMRAETFMAAHLLKKRHLKLQKRKYLALYNKSKKVEADMRCIVKRRTTKRAAAALGAAAIRLKK

SEQ ID NO: 7492 - protein, 76 aa, synthetic construct
LFRWYRRFYKFLRNLLRRLLHFQTRCLALKRNATMIRPLLNARKALARLILQNIGFREQRLRPAYKTCEIELKSKA

SEQ ID NO: 7493 - protein, 49 aa, synthetic construct
FLRFFPKLMKRLHNHGKALAFALNRYKCKLLPRHKALDLVKKARRHKWG

SEQ ID NO: 7494 - protein, 71 aa, synthetic construct
RIRFFKRLFKWFKCLAKRYNYKRYTGIICHTMLLKAKADKLANTLCWRKAKLRKARNGPPLAVRHKKALKD

SEQ ID NO: 7495 - protein, 44 aa, synthetic construct
MLRLYKRMLKLLKRENKYKYARARKADATWARKTTDCERTLPRS

SEQ ID NO: 7496 - protein, 30 aa, synthetic construct
LYRYLKKLLRLIKCCKRLKMNMFIERVSKL

SEQ ID NO: 7497 - protein, 24 aa, synthetic construct
LLKMYTKYLKKYKQHKAAKVAHKD

SEQ ID NO: 7498 - protein, 24 aa, synthetic construct
LLRLLKRLLKKLSRMDMAGKHRLN

SEQ ID NO: 7499 - protein, 65 aa, synthetic construct
KLRLLQKMLKYFKKLGKLVANLSLYTRHRDIQCLLRMKHVLRRAVVRDGPKSQRKAKCCKFAALD

SEQ ID NO: 7500 - protein, 64 aa, synthetic construct
KIRFFTRLLRRFRTILPGKLVLAYLAIMKCRAGEKLALSLLLRIDSFARDRAAECARRMLKAFL

SEQ ID NO: 7501 - protein, 48 aa, synthetic construct
MYRFFKRLLKMITCRAAMLRRGLIMGLSTTRRLDLVGKRFRLKAKRRL

SEQ ID NO: 7502 - protein, 22 aa, synthetic construct
KLRYFPKIFKKYKHAAAHWLAK

SEQ ID NO: 7503 - protein, 33 aa, synthetic construct
MLKMLSKWLRRLSKRRCQKAKVPKSTANKLALQ

SEQ ID NO: 7504 - protein, 30 aa, synthetic construct
RIKLFPKWLKLMKKHMLACLMGRKRLLIKF

SEQ ID NO: 7505 - protein, 20 aa, synthetic construct
LLKLLTRIFKRIRKRAADFL

SEQ ID NO: 7506 - protein, 22 aa, synthetic construct
ILKFFRKLIRRLSRARATLSTW

SEQ ID NO: 7507 - protein, 27 aa, synthetic construct
KMRFISKLFKRLNTRLKVKAQAALAKL

SEQ ID NO: 7508 - protein, 41 aa, synthetic construct
FLRLFKRLLRLLNTGIKLTPLRTGLLRAWPLCDKMAAMRYK

SEQ ID NO: 7509 - protein, 65 aa, synthetic construct
RLRLYKKLIRFIPSTIACVKRKQRLRAAQALPPLKLRSRRHYLVNKLCMHKKDERAKKLPFCANE

SEQ ID NO: 7510 - protein, 32 aa, synthetic construct
RMKLYNKWFKKWRRKWRISVKYLAGAAAAQLW

SEQ ID NO: 7511 - protein, 45 aa, synthetic construct
YLRIMPRLLRKLKKGDTISLTKKRLRADNSRLRCCAHAHLGLRFE

SEQ ID NO: 7512 - protein, 30 aa, synthetic construct
KWRIMTKWLKRLKNERILLAVDLAAKRIEH

SEQ ID NO: 7513 - protein, 28 aa, synthetic construct
ILKILKKLFKKLKRQRMAYNRLAPRSLM

SEQ ID NO: 7514 - protein, 25 aa, synthetic construct
LFKLFRKYLKFLRRRKPVAACKAAN

SEQ ID NO: 7515 - protein, 74 aa, synthetic construct
LFKLWRRLMRKLSTAKVIASAAKAMKVLAKWICRKLHRLKDWKKNCKDYKPDILCRNKCSKYKIKHKWAAKPCA

SEQ ID NO: 7516 - protein, 30 aa, synthetic construct
RLRILTKFFKRLKCGLKAQFASMTPFAALA

SEQ ID NO: 7517 - protein, 73 aa, synthetic construct
LMKLLRRLMRKLKKDKAAAMLAKKRCAIRKVKKKRCAKPFMCLNLKQQRMKRAEIEAFKECKRACASASRAMS

SEQ ID NO: 7518 - protein, 27 aa, synthetic construct
RLRLFCKWFRILNKAFQRKEAKAAFCY

SEQ ID NO: 7519 - protein, 78 aa, synthetic construct
RLRFMNKFFRKLRRTCNLLMLSCLPAQTEERKDLTAGLLLKHTRMKRFAKNRLLPHDKLGRRKHKLSQLLLPAPCLKH

SEQ ID NO: 7520 - protein, 22 aa, synthetic construct
LIRLYKRFWRFLNRAKIHSLRA

SEQ ID NO: 7521 - protein, 20 aa, synthetic construct
KWRIIQRFYKRLRKLLNLQA

SEQ ID NO: 7522 - protein, 38 aa, synthetic construct
LLRYLRRLLRKIKSRRMRAARYGQDFISMILQLLFKAF

SEQ ID NO: 7523 - protein, 98 aa, synthetic construct
KWKWLRKLLRFMQCIKAKYWLMYNAKTHLAQPGEKAAWAKKLAPQMAINDLTKLHALPGLCKRMSDKERANMASRIKVSKLKLKERCRQKKFKRLRAA

SEQ ID NO: 7524 - protein, 36 aa, synthetic construct
KFRILKKIMKRFKRAGELLAHALLKKSWETLALQIW

SEQ ID NO: 7525 - protein, 25 aa, synthetic construct
LLKYFKRMLRRLQCVLFKKVLLDAR

SEQ ID NO: 7526 - protein, 37 aa, synthetic construct
RLRLYRRLLRRYQKAWINIILRLAPYLCAEARQNMKG

SEQ ID NO: 7527 - protein, 66 aa, synthetic construct
RWRLISRLLRRLKRKDAMRKKWAKRMASMILRGSLPPTLFCSTKPARGLKNKAWAGRTLAEKRDRM

SEQ ID NO: 7528 - protein, 97 aa, synthetic construct
RWRYWRKLYKRFPTDLDAPRPHLKALCALLTWHRWFGNCVARYLYLYLKLTEADVLRPEAAKKLRARRCMLRKMIWRRAPGAWKKGRALYRMKWRLR

SEQ ID NO: 7529 - protein, 23 aa, synthetic construct
YFRLFRRIFRRLSSRALRVRGAL

SEQ ID NO: 7530 - protein, 50 aa, synthetic construct
IFRLMKKILKKLRRVQPDALKSHCAVYAYKAAHAADRARLPTGARRFLAW

SEQ ID NO: 7531 - protein, 33 aa, synthetic construct
LFRLMQRIFKKLRRLKLDSFKTALKAYRGESKT

SEQ ID NO: 7532 - protein, 29 aa, synthetic construct
RWRLLPKIFKRLKRYVQLLARPLEALRAG

SEQ ID NO: 7533 - protein, 31 aa, synthetic construct
WLKFFKKWMRLMRKAAILKQALLARQTVKRT

SEQ ID NO: 7534 - protein, 43 aa, synthetic construct
RLKLLKKWFRFMQKLSLAKLALQNIQFYCMAQERNRMKARREA

SEQ ID NO: 7535 - protein, 32 aa, synthetic construct
YIRFYRRFMKLLHKQDSARALRTKFCKSAAAK

SEQ ID NO: 7536 - protein, 64 aa, synthetic construct
LFRIWHRYFKWLRTGYIARCQRNLAVRVAADFKAKLRWWALIGRRNLRAKAKRRWRHMHKVRRL

SEQ ID NO: 7537 - protein, 65 aa, synthetic construct
LFKMIKRLYRKMHSALAAHLRVLKKAGGLKLKKRGKRNAAPLSDFRTPKMAYWILYKHIKYKRWN

SEQ ID NO: 7538 - protein, 42 aa, synthetic construct
RLKLWRRMLKLYHRRKAALRPVERKLTRRPRFWPSLKWAALC

SEQ ID NO: 7539 - protein, 36 aa, synthetic construct
KLRLLKRYMKYYNKTIIRSALWFLLRSKLLGARKKD

SEQ ID NO: 7540 - protein, 45 aa, synthetic construct
LWRLIRRYYKRLTKQHLLTKRKTKKGASAHLIKRKEGWAEHAVTL

SEQ ID NO: 7541 - protein, 40 aa, synthetic construct
KLRYMKKYFRIWKRCCKAKLDQWLSERLQLRALAKALWLL

SEQ ID NO: 7542 - protein, 35 aa, synthetic construct
ILRLLKRLFKRMRKGIKRELALPRDMMILTPKTAY

SEQ ID NO: 7543 - protein, 37 aa, synthetic construct
RLKLMRRYLRLLKREIMLGRSPAIAPVRAKRTLNDYA

SEQ ID NO: 7544 - protein, 31 aa, synthetic construct
MFKFLPKFLKKLHKIAALADRRLLRALDKRA

SEQ ID NO: 7545 - protein, 78 aa, synthetic construct
RLRWLKKWWKKIHKLKQYYRLLKLPAALHCAHLHKAKQQKTNAFWWPLGQGLKVLRGRTRLNMVANRGLLWLPRAPAR

SEQ ID NO: 7546 - protein, 35 aa, synthetic construct
KFKLYPKIFKKFKKFACKLLSAASAFASRLGRCAW

SEQ ID NO: 7547 - protein, 72 aa, synthetic construct
FLKYLRKLFRFIRRKKREGMCACQLKAGRYALRLFALRGALAMEKVRPGKKLREWKVAKRSPHLAGMKVLFR

SEQ ID NO: 7548 - protein, 36 aa, synthetic construct
RLRMWTRWIKFFNRAILGLLALLALTRRTCRFAIYR

SEQ ID NO: 7549 - protein, 24 aa, synthetic construct
LLRMLRRLFKILHRHARKYILISR

SEQ ID NO: 7550 - protein, 32 aa, synthetic construct
LLKFYTRLMKILCRNRLANTLFRALSKALIKR

SEQ ID NO: 7551 - protein, 35 aa, synthetic construct
LYKFFTKMLRFLRKLLAIKPAKKDARLAKSRFYSY

SEQ ID NO: 7552 - protein, 25 aa, synthetic construct
LMRLLPKFWKKMRKQLELAKRHLKW

SEQ ID NO: 7553 - protein, 24 aa, synthetic construct
RYKLLCRFFRRFRHTAMAEMALKK

SEQ ID NO: 7554 - protein, 33 aa, synthetic construct
WYRLLNKLYRKLRRMVTAKKLADDDPANQAANK

SEQ ID NO: 7555 - protein, 91 aa, synthetic construct
RFKYFKKLIKKLRKRKAHFADRDAECMALALLKKACQDAIRNRTAKSRLLRVRKVAARSSARRQPCACKPDADALKTKKNECEVQAWYPLG

SEQ ID NO: 7556 - protein, 53 aa, synthetic construct
RLKLMKKFFRKLPKLKKFDEPADHMGLAAALEHVLRRYRKLLGGAKAAGCKQP

SEQ ID NO: 7557 - protein, 20 aa, synthetic construct
RIRLMKKLFRLLTPAHPMML

SEQ ID NO: 7558 - protein, 20 aa, synthetic construct
FFKLWKRLLRWFRKGHAAES

SEQ ID NO: 7559 - protein, 30 aa, synthetic construct
RMRLLCKFWRKIHKKSKWLVHERLALIARW

SEQ ID NO: 7560 - protein, 56 aa, synthetic construct
RWKLFKKFLKIWRQRHKAARLQRDNHNLSRLRKQMKLALKMAVYKQLELETLREAK

SEQ ID NO: 7561 - protein, 21 aa, synthetic construct
RYKFIKKFMRLMHRKALDAML

SEQ ID NO: 7562 - protein, 37 aa, synthetic construct
KMRFLCKLFKLYKNKRKNKLALAAALWSDLSSFRKAT

SEQ ID NO: 7563 - protein, 22 aa, synthetic construct
RFRLYKKLLRRFRPLHIAQLRE

SEQ ID NO: 7564 - protein, 54 aa, synthetic construct
WIKILRKLLRRWNCLKINDELKWALPRRAQLIIRQVKIAGKILLGRKRIAVDKK

SEQ ID NO: 7565 - protein, 39 aa, synthetic construct
RLRIIQRILKKITHALVKIRPLLKLNSKRAEWKMAVADL

SEQ ID NO: 7566 - protein, 42 aa, synthetic construct
KFRLLSKLFRRLKRIKSILCECILDNAFLKLNEAKIKKLRHA

SEQ ID NO: 7567 - protein, 88 aa, synthetic construct
KLRMLHKFLRRLRKSYGAMLRCAHLKEKFKACTAKLAKKQRALIDFGKRLFKLRRAEKLAYSSHFTPRCNKARLALNLIPEARNLAFT

SEQ ID NO: 7568 - protein, 23 aa, synthetic construct
LFKFLHRFLRYWRNRVIAARRAP

SEQ ID NO: 7569 - protein, 54 aa, synthetic construct
LMKFLCRLLKKLHRPCNAKFPRKQKRLACECLRFAPEAQLKLAGRRYKGHLLAH

SEQ ID NO: 7570 - protein, 32 aa, synthetic construct
RFKYMRRLIKRLRKAVLFCHALMCKASDSARA

SEQ ID NO: 7571 - protein, 52 aa, synthetic construct
YLRILKKLLKYYRKESTLYLTKKLKPNINALADRRSLARALCNRKSQLMRRW

SEQ ID NO: 7572 - protein, 54 aa, synthetic construct
RMKILRKMLKMLKHAARPPLLKLRAMSACRAFLAHMMQCFRRLAVQRGLWFRKA

SEQ ID NO: 7573 - protein, 69 aa, synthetic construct
KIRMFKKILRMLQRAERLLKKRAVKAEKQARKYVHIKRKYEATSFAVKTWMKLLHTPKLLVLSFKPAGR

SEQ ID NO: 7574 - protein, 48 aa, synthetic construct
RLKFWQRYMKKISKLILLLTARPIKLKHKKSYASALDDLCAAKLNAHA

SEQ ID NO: 7575 - protein, 58 aa, synthetic construct
RIRWMRKYFRLLKKDAPLRQGGLTLLRNCKPWVAALKKSNTIQLRRNAGKTKRANARA

SEQ ID NO: 7576 - protein, 31 aa, synthetic construct
YMKFFKKLLRLFKHRTDAGAARKEKAATAKL

SEQ ID NO: 7577 - protein, 23 aa, synthetic construct
WLRWISRLWKRYRNLLPAAIAQK

SEQ ID NO: 7578 - protein, 70 aa, synthetic construct
LYRILKRLFRFLRTNLAWKYQQAICKCCTLAALKLKKLRRLEAHHRLKIKHKCDRGLLDKAGGPRALCLW

SEQ ID NO: 7579 - protein, 58 aa, synthetic construct
KWKFIKRWFKKMRNKYAFLSLAKRLRKLTRLSHLALICITAEKRSALELLGWKFWKLF

SEQ ID NO: 7580 - protein, 42 aa, synthetic construct
KFKLMKRMMKLMRRALKKKKRFHDAMLMENLTAWLLWNISAL

SEQ ID NO: 7581 - protein, 80 aa, synthetic construct
KIRYLKRLWRRMKQVLLAGKIAKSKKAKKRKWIWAKFQKVASLTLRRMEMGIDEAGKAFGGARWAFCLSFRLKKSKEAAC

SEQ ID NO: 7582 - protein, 45 aa, synthetic construct
LFRWLCKLWRRMKRLRGVKGLHLPAARNNYALKTLRECNALFWAA

SEQ ID NO: 7583 - protein, 58 aa, synthetic construct
KLRLMRRFIRKLRRKICASKPLPLLLALLKFGSKASKCTAWALLLYQKYHRLQNLLRD

SEQ ID NO: 7584 - protein, 32 aa, synthetic construct
KFRIMPRLLKLWRRIALSANKAEDAASLQRDL

SEQ ID NO: 7585 - protein, 69 aa, synthetic construct
KLKLWKKFFKRITKCRRPLLTPSFKEERLRLLPMQKAAASEEAMTHRKRAALKTHAMKKAHFALCFKWV

SEQ ID NO: 7586 - protein, 34 aa, synthetic construct
KMRLINKYFKRLSHALLHRRADAAILLRWISKRM

SEQ ID NO: 7587 - protein, 33 aa, synthetic construct
IYRLFKRLWRRLSPCAAIALEARGAWAKTDSRK

SEQ ID NO: 7588 - protein, 49 aa, synthetic construct
RLKLLRKLLKFLHKAAARHRKLIAIQKAGKYWIRAFYAYWTLCCINPRA

SEQ ID NO: 7589 - protein, 45 aa, synthetic construct
RMKLFPKWLRLFKRQPFKAKLLRAALACELRPDRTHYLKHKKALV

SEQ ID NO: 7590 - protein, 33 aa, synthetic construct
WWRFWRRLFRRYCRRPRLLLAIARFLLLSNLNL

SEQ ID NO: 7591 - protein, 28 aa, synthetic construct
KLKMLRKWLRRIRQNAKQLAQARPAAQL

SEQ ID NO: 7592 - protein, 64 aa, synthetic construct
YFRLYKKLWRWMRRKMKNTWCALRDELEWKGLKGLARHALAARSSKRKPRAPEANKRDWLCKAS

SEQ ID NO: 7593 - protein, 33 aa, synthetic construct
KFRMIRKLIKRWHKRDELKLNRALALMGCPLQA

SEQ ID NO: 7594 - protein, 57 aa, synthetic construct
KLRLYQRLIKLLNKMYKLKHRKHLALELPHAATKCAPNAEIPLCPKFAKRLWGKLDD

SEQ ID NO: 7595 - protein, 27 aa, synthetic construct
WWKLLKRIFKKWSKGMSAYRLAVALQL

SEQ ID NO: 7596 - protein, 56 aa, synthetic construct
RLKLLRKMLRRMCSWNVEHARYKVTRHHRAFLACYKMKRVIEKLASLILPARKART

SEQ ID NO: 7597 - protein, 21 aa, synthetic construct
RYRFWRKYLKYLRKLCDWLTA

SEQ ID NO: 7598 - protein, 33 aa, synthetic construct
LWKFMPRFLRMLCKRQRDAADCLLRAPYALRGK

SEQ ID NO: 7599 - protein, 90 aa, synthetic construct
KFKYLNRILKKFKKALTPALQSRKYTRIRSKARRAMTFRACPLVREASDTARRLLHAKPFSLLINVPDRTRRKRRATAYYHLVLLPKRAA

SEQ ID NO: 7600 - protein, 40 aa, synthetic construct
MFRYFHKMLRKYKKKKERALFHMALTCRKAPNLNLNLRRD

SEQ ID NO: 7601 - protein, 54 aa, synthetic construct
KIRWIRRMWKRYQKIPLVCKRLQEALSKKLQSRRSKALFRHRKAAAQYALHPLR

SEQ ID NO: 7602 - protein, 24 aa, synthetic construct
FMRLFRKYFRLLHTNAKLRATLHK

SEQ ID NO: 7603 - protein, 41 aa, synthetic construct
WIKLLKKWIKKLRHRRRSKLQMTLDQCFKLLLKNRYAWMFA

SEQ ID NO: 7604 - protein, 40 aa, synthetic construct
KFKMLKRLYRLWRQWKRDMNNAMTGIQALRRTKRDALLRF

SEQ ID NO: 7605 - protein, 64 aa, synthetic construct
RLRLFRKFMKKLKRKDARYSGRLQALHAALCFRALVNFTWTRMAKLYKDLLPALPFHELLGLWY

SEQ ID NO: 7606 - protein, 24 aa, synthetic construct
WFKLWSRFIKRFQSALQKRAAKLA

SEQ ID NO: 7607 - protein, 33 aa, synthetic construct
KWKLICKLYRKLNCAKRAFACASSKSDRLYRKH

SEQ ID NO: 7608 - protein, 20 aa, synthetic construct
LYRYLKRLYRKLCNACLHAK

SEQ ID NO: 7609 - protein, 46 aa, synthetic construct
RYRYIRKFLRIFHSVTRAVYLLTKKLRMKLALLVLAKAIRVHALKV

SEQ ID NO: 7610 - protein, 30 aa, synthetic construct
RWKWWRRYLKRFRTLDKQADTWVKARLVAA

SEQ ID NO: 7611 - protein, 38 aa, synthetic construct
RYRLFRRLLRRLNNAKISLAFQLVKKWLHHINYMALLR

SEQ ID NO: 7612 - protein, 20 aa, synthetic construct
RLKLLRRLMRKWNNLLSLRV

SEQ ID NO: 7613 - protein, 90 aa, synthetic construct
KLRLLKRYMKYLKSACKKTYKARRNLWYRLKRLRKKALHDFAKLKYCKKKERLCLKMGHEAQCKAYAAYKALGTYRKSREKMGTHKVPGA

SEQ ID NO: 7614 - protein, 77 aa, synthetic construct
LMRFLQKFIKKLKQQSTGLRHVLRKRKLRTRNLTYRSHAAHRNQSLNLAAAARLHGNKREHGTKKARTKALWDKKRL

SEQ ID NO: 7615 - protein, 60 aa, synthetic construct
FLRMLNRFLRLFKPTRRAKTCERLKKRVKMRLFYLAYRITMEAPALIKAPVEWLLRKKCI

SEQ ID NO: 7616 - protein, 56 aa, synthetic construct
LIRLLKKLFRRFNRALIIFAKLAAGVKALKLFKVQAKLWACKNPSYKMPQYMRWHL

SEQ ID NO: 7617 - protein, 38 aa, synthetic construct
KLKLFKKLFRKLRQRALAASGDAISKYCAFNFHHKVAI

SEQ ID NO: 7618 - protein, 35 aa, synthetic construct
RLKLLKRYLRLLHRYQNMFIIVWLLKLRKYKKLKK

SEQ ID NO: 7619 - protein, 40 aa, synthetic construct
RYKLFRKWIKRLSQDRSLALRIYAHRTRMLLILLAAIKLL

SEQ ID NO: 7620 - protein, 36 aa, synthetic construct
FFKWFRKLLKMYRTCPCWDARRAPLQKLKLLREKKL

SEQ ID NO: 7621 - protein, 53 aa, synthetic construct
RIKFFKRFLRLWKKEIVRFGGELRDKDARLILVPRKYLAKDTLPLLRAARPLM

SEQ ID NO: 7622 - protein, 32 aa, synthetic construct
LWRYINKYIKLLRCGLLKHGLALRVNARESAR

SEQ ID NO: 7623 - protein, 52 aa, synthetic construct
KLRWLTRFYKLLTRSHKSKRCWLWLLNRLPLEDYKATAMFYKEAKFAAWRRK

SEQ ID NO: 7624 - protein, 22 aa, synthetic construct
KLKLWNKILRWLCKKLAGRARR

SEQ ID NO: 7625 - protein, 68 aa, synthetic construct
LYKFFCRFFRFLHRLKAAATCSYPRRRERGKLRHARLKAQGIKKKWRLRGHRTGAKYNNARWALLCLI

SEQ ID NO: 7626 - protein, 45 aa, synthetic construct
KFRWLCRILKFYKRKKEPNRMARLQLQRLAYLEAPRADLIRHLKQ

SEQ ID NO: 7627 - protein, 70 aa, synthetic construct
LWRYLHRIFKKWQRKRLGKKAKKAHLVGREEKMMPARFNKLCMDLLCPRAKPLLRRKARKASCLAKSPSW

SEQ ID NO: 7628 - protein, 50 aa, synthetic construct
RWRLLRKMFKKLRRACRFLPKRGSVADQHLCAAIIKGRRRVALHILRRLK

SEQ ID NO: 7629 - protein, 98 aa, synthetic construct
LFKILRKFYKLYKRSWAGDHQKQLNRLLQEHRLKAKALESRCTCRKVRKVKKLPRHLKLKWSLKVLLCKPPFAAQNFYVPGLAPALDRKKCRKRNLQL

SEQ ID NO: 7630 - protein, 28 aa, synthetic construct
LLKIFRKFLRKLHKQLQERAKDSYAYSK

SEQ ID NO: 7631 - protein, 25 aa, synthetic construct
IMKLYRRFYKLFCKKPAKAHAVNKA

SEQ ID NO: 7632 - protein, 81 aa, synthetic construct
ILKMFQKILRRIKCKYWAQALDACKNLKRKPKCRQKILVYNRKLKCAANPGKALTLRAYMFERKRPLAALMLILLMTHLAW

SEQ ID NO: 7633 - protein, 52 aa, synthetic construct
YYKLMKRLLRRLRKILVFCKYAEQGKRIPRLPKIGALPVRKKKLLVVIAAAR

SEQ ID NO: 7634 - protein, 24 aa, synthetic construct
KYKYLRRWMKKWSRKWLLLLKMLL

SEQ ID NO: 7635 - protein, 48 aa, synthetic construct
LLKYFCRLIKIMSSKKKRLIEALPFSLRAAMHFEYVKKPKIRALLLAR

SEQ ID NO: 7636 - protein, 28 aa, synthetic construct
MLRLMSKLLRMMKNKTESKLLRRRFALE

SEQ ID NO: 7637 - protein, 34 aa, synthetic construct
FIRLFKRWLKKFNNLAQAKHAALKIRPRATFILK

SEQ ID NO: 7638 - protein, 23 aa, synthetic construct
WLKLMSRWLRRLKQRLLGEIASA

SEQ ID NO: 7639 - protein, 33 aa, synthetic construct
LFRLFPRLLKMFRRSRAKRLCQKLWKNLRRLLE

SEQ ID NO: 7640 - protein, 41 aa, synthetic construct
FFKYLKRILKKFKPRRALLGKRYAGHLWLHAKWYNEALWHK

SEQ ID NO: 7641 - protein, 40 aa, synthetic construct
KLKLYQKWLRRWPNRYHFLAAAVIRLFKKKKQRKALDYVR

SEQ ID NO: 7642 - protein, 56 aa, synthetic construct
LFRYWNRFLRKMPCAKLLVKSALKEARPYLKFRAPKIHCRWLLRKALYKRWGLWAP

SEQ ID NO: 7643 - protein, 34 aa, synthetic construct
KLRFIKRWLRLLTCKKLLWPHKVAWRGKLLRNRT

SEQ ID NO: 7644 - protein, 66 aa, synthetic construct
KLRMFHKLLRYLCRKAGKQCMERPLKLAKMRITCLLAKALRRLRFRCYEKACKATECTQLRQADLC

SEQ ID NO: 7645 - protein, 33 aa, synthetic construct
WLKYMNRFYKKLKKTTWNMLKKLLAAWSLMALK

SEQ ID NO: 7646 - protein, 73 aa, synthetic construct
FLKLLTRILKLFRKFKDGKLKDAKGFFACMRRPYWLRLRRLRNMLADKRTLNALRDFAYKFVKRVKVTGARHA

SEQ ID NO: 7647 - protein, 44 aa, synthetic construct
YFRLLRKMYKKWKKESKAPKNASRLDYVARTRWALAARSAMAQN

SEQ ID NO: 7648 - protein, 26 aa, synthetic construct
RLRLLCRLLKFLPSTLWKPCLKHPKA

SEQ ID NO: 7649 - protein, 25 aa, synthetic construct
RFRLFKKMFRFWKHKLSCALKASIL

SEQ ID NO: 7650 - protein, 40 aa, synthetic construct
LLRLLKRLWRKLTPKEAQKVCDRFHLNLNTYALKRESLKM

SEQ ID NO: 7651 - protein, 20 aa, synthetic construct
IFRLLHRMLKWFRSYLKAIR

SEQ ID NO: 7652 - protein, 87 aa, synthetic construct
KLRWLPKYLRWIRTHAAEELAHERACLDYKDMAPLKWRKKRDRLLNLALVAKPALSLAHWKMSLHLKDCGLRLKNQTYKTKMRFILA

SEQ ID NO: 7653 - protein, 74 aa, synthetic construct
RMKLWKRFYRKYRQYAPCPKAATAWKARSARLAWAIWFAYHEAKTRERLKLETQKWRHDAKRERLRLQCKINRR

SEQ ID NO: 7654 - protein, 33 aa, synthetic construct
KWKMLRKLIKLMTKMNQLWALKTFALKKLSASA

SEQ ID NO: 7655 - protein, 33 aa, synthetic construct
KFRFLRKLFRKLRPFLLLFKLQNQKLNITRART

SEQ ID NO: 7656 - protein, 45 aa, synthetic construct
RFKLLKRFIRRLRRDVYNCWPRNTLAKRMQLRKLAYCDNKLACHL

SEQ ID NO: 7657 - protein, 23 aa, synthetic construct
KLRWIRKFFKLFRNYRRWAAYLL

SEQ ID NO: 7658 - protein, 36 aa, synthetic construct
RLKLIRKFIKWLCTVLLKAPKRKRELPMKWALLLMV

SEQ ID NO: 7659 - protein, 50 aa, synthetic construct
KIRWWKKWYKKLRSRLWEACKLPRIDLVKTLYLAVRMACRLLYELLRNEA

SEQ ID NO: 7660 - protein, 27 aa, synthetic construct
RLKLFHRLFRLFTRLFKAILKDTHMKF

SEQ ID NO: 7661 - protein, 37 aa, synthetic construct
LFRLLQRWLRRLRRQIKDLRSRYKLGLAEAMVSKPRR

SEQ ID NO: 7662 - protein, 43 aa, synthetic construct
RIRMWRRMFKLIKKAMFDCAMAHRPKWTLHALIPMRALRLRAR

SEQ ID NO: 7663 - protein, 34 aa, synthetic construct
KFKWFRKLMKFLPHVKAMRLSENARAAKRAHDLH

SEQ ID NO: 7664 - protein, 56 aa, synthetic construct
RLRYWRKILKKLTSRADALKRAAAAERLMIEKYGRIVYTYVLAKYVRPWRLRPPRN

SEQ ID NO: 7665 - protein, 40 aa, synthetic construct
RIKFIRKLLRMMRQDLLIAAKFKNAVEVKKKSYMLLLDLK

SEQ ID NO: 7666 - protein, 100 aa, synthetic construct
KLKLISRLLKFLPKFELLGYWLKMTRRNLMRIKALKALRNRARPLNGFRRTLVALMPLYAKLKNAHLARGLAQAKKVRMLYKGMLDNILWHHALYLERPC

SEQ ID NO: 7667 - protein, 65 aa, synthetic construct
FLRLLKKMFKRIKKALRVTSRVRGRMRALLWRKLYFKAKNHASPHRQAALQLTPDNHEEEKLANR

SEQ ID NO: 7668 - protein, 50 aa, synthetic construct
RYKLLKRLMRILKKAAWQMLWIRENHKKKHQKGGSLKREALFKNQSRLDA

SEQ ID NO: 7669 - protein, 27 aa, synthetic construct
LYKLMHRWLRWLKKYHNFALKARQKLL

SEQ ID NO: 7670 - protein, 34 aa, synthetic construct
RIRLWPKFWKRLRRAYMANAAARHKWVTAKLCTF

SEQ ID NO: 7671 - protein, 41 aa, synthetic construct
RFKLMKRFYRFWPNAAAKKKPDLYANRGARALPLHIKKKRA

SEQ ID NO: 7672 - protein, 23 aa, synthetic construct
KLKFFNRFIRKLSCAAAKTMGAK

SEQ ID NO: 7673 - protein, 29 aa, synthetic construct
RFKIMSKLLRFYTKLLLLMLKQIKKDSKL

SEQ ID NO: 7674 - protein, 29 aa, synthetic construct
RLRMWHKLWRRLNQAIACPKKAMKRLDAQ

SEQ ID NO: 7675 - protein, 48 aa, synthetic construct
WLRLLRRWIRMFRSCLAKDNNKRCQLACVNFLKDNGCRAARARKCALR

SEQ ID NO: 7676 - protein, 26 aa, synthetic construct
KIKLFHRLLRKLSKRCLARGARDAKN

SEQ ID NO: 7677 - protein, 54 aa, synthetic construct
KIRLLRRLLKLLNTKACREARNEAKKQNNRLKSWSHKCNAKLQRMTPRDRKLLE

SEQ ID NO: 7678 - protein, 48 aa, synthetic construct
RWKFLRKFYRKYNKAALLLRLRRVAHFWRLVKLACARRKPCHLEKHAI

SEQ ID NO: 7679 - protein, 59 aa, synthetic construct
RMRYWPRLWRLWPRQRNAKYAKKKSNRLKKLLIKNLALVLSRPAWLPDWWAQLVLLLIK

SEQ ID NO: 7680 - protein, 92 aa, synthetic construct
LYKFFKRLFKYLRKDWPRAKLMRDALIAAKKWKAPKKKSKAYQKLACLKAKAADRGANKKLNKMARVYNLDRARWSADRKKGLRFYMDRPAE

SEQ ID NO: 7681 - protein, 27 aa, synthetic construct
RLRFMNRLWRRFRHLLLARLLACNRFW

SEQ ID NO: 7682 - protein, 26 aa, synthetic construct
KLRLIPKILRFFKQYKLAALRARGRK

SEQ ID NO: 7683 - protein, 37 aa, synthetic construct
RIRFLRRFLRRFQKRRLWMLAWAPARLLTWKWKARAT

SEQ ID NO: 7684 - protein, 66 aa, synthetic construct
RLKMFPRLIRKFRKPAWPKAYLILYLLKFLLPYAGRLIKTCYKELMRKRRLPWLRMRQQRDRLNKP

SEQ ID NO: 7685 - protein, 36 aa, synthetic construct
LMRFFKKLYRKFRRALCKEKCFVKKCLPTAPLILAR

SEQ ID NO: 7686 - protein, 21 aa, synthetic construct
LFRIFRKFLKKFSRSDAANLL

SEQ ID NO: 7687 - protein, 78 aa, synthetic construct
RYRYLKKLLKIFPPTPAKIHKTKLKARLAGRSVRAKLLCHYLALLEAFAGRKHAKRKAMASDRLKCQKIAARNSCQVH

SEQ ID NO: 7688 - protein, 62 aa, synthetic construct
RLKLLTKFFRFFKRMALLARLKKKKTAAHLTLPHQEAARKALLYFKPRRAELWMRLMRVLLR

SEQ ID NO: 7689 - protein, 21 aa, synthetic construct
YLKLLHKLMRLWNKRERIIGL

SEQ ID NO: 7690 - protein, 51 aa, synthetic construct
KWRYIRRWIKLMRKGVMQYAARMAREVKAALRKFLLREPLLVKRHCAILWK

SEQ ID NO: 7691 - protein, 21 aa, synthetic construct
MIRLLKRLFKKFKSKNLAIAA

SEQ ID NO: 7692 - protein, 28 aa, synthetic construct
LFKLYRRFFKLYRRLVISKPARISRTLA

SEQ ID NO: 7693 - protein, 23 aa, synthetic construct
FLRLMKRFLRKWPNALKKKIAHC

SEQ ID NO: 7694 - protein, 79 aa, synthetic construct
KLRYWRKYFKLLRRELVIKFARGRKDLLKMGYPAAKHLPDAVWFAQLTARLFKWLWQRYYNAAGILRKRKYRRALCYLW

SEQ ID NO: 7695 - protein, 23 aa, synthetic construct
RLKFLRRLLKKMNNTASEGARVL

SEQ ID NO: 7696 - protein, 39 aa, synthetic construct
KLRWLCKLIKWFPHLRAERFLAKVMLFRAVIRRKYKDLM

SEQ ID NO: 7697 - protein, 61 aa, synthetic construct
KLRLYKRLLKKYKKVCKDKRVRLFFLRPANTYLQRARVLACTHYKNHLPANAALTWKLNWN

SEQ ID NO: 7698 - protein, 35 aa, synthetic construct
MYRMYRRIYRKLKRLARIEANKLARGFLCARCLYR

SEQ ID NO: 7699 - protein, 42 aa, synthetic construct
LYKFLRRLLRKMHHTRQTAYLKTPAAWALWKLVTLLRKKSPA

SEQ ID NO: 7700 - protein, 40 aa, synthetic construct
KFKFLKRLYRLFKKVKGKATRAILMCKKLIILWWHMEELA

SEQ ID NO: 7701 - protein, 27 aa, synthetic construct
RLRIMPKLFRLFRRTAARRLCNNLTGI

SEQ ID NO: 7702 - protein, 39 aa, synthetic construct
KLKFYRKLFKYMRKSWYQAWARNAWALARGWARAQFARR

SEQ ID NO: 7703 - protein, 41 aa, synthetic construct
KYKWMRKWFRYLKKIWLLKASKRNRRFPLNVAALYKNLKAL

SEQ ID NO: 7704 - protein, 20 aa, synthetic construct
IYKLLPRWLKRFQQKLAACL

SEQ ID NO: 7705 - protein, 44 aa, synthetic construct
KLRMIKRMLRFYKKAAQKCGATRKKAPASLLSRYAASRMHLSIK

SEQ ID NO: 7706 - protein, 66 aa, synthetic construct
KIRMWTRFMKKYQKLRDASWHLRIGEAKALAARWLKKAARLEIKYADETAFKALEKLKLHLRNVCI

SEQ ID NO: 7707 - protein, 67 aa, synthetic construct
LLRMMCKFYKKFRKKTLARAGLAKLKLLNRPEKPDFVNKGRGWGLAYLLASAYALFKPIPAATAMSK

SEQ ID NO: 7708 - protein, 30 aa, synthetic construct
RIRFLTKWIKLFQRKRLLAKELVAVRKKDL

SEQ ID NO: 7709 - protein, 90 aa, synthetic construct
RFRLIKKFYKLLRKDKNPAKRLKKRAYRQRLQAASKCFQARPLLRLLLFKHEKKAALAIERDQCKRLALFFKDRLCARLALLLFKSRHWT

SEQ ID NO: 7710 - protein, 21 aa, synthetic construct
YYKLYRKLFKKMRQKLMAPYL

SEQ ID NO: 7711 - protein, 27 aa, synthetic construct
LLRYMPKMLRKLNKHIMPAGHCAARKL

SEQ ID NO: 7712 - protein, 26 aa, synthetic construct
YWKLLRKIFRKLSQRQDAHKAALKHM

SEQ ID NO: 7713 - protein, 58 aa, synthetic construct
KLRFFNKIYRRFQTQRRRLLDRWARLVDMKSRYRCMALQNKVSAAALRRANRAHARMV

SEQ ID NO: 7714 - protein, 22 aa, synthetic construct
YWKLLSKLIRKFRKYPAKAALK

SEQ ID NO: 7715 - protein, 39 aa, synthetic construct
KLRLFQRYMKLLKSLAQKWLFLLRVRLAWSAKCNRDRQR

SEQ ID NO: 7716 - protein, 23 aa, synthetic construct
RWRLLKKLFKKINKALDCILETT

SEQ ID NO: 7717 - protein, 59 aa, synthetic construct
KLRFLNRFFKLLCHHLPELLAEYTVRAQARKRSWWVPILLRRLRYRMRQKRARAHKKAA

SEQ ID NO: 7718 - protein, 26 aa, synthetic construct
LYKLYKRMFKFFKHAGKLAKLAPQRK

SEQ ID NO: 7719 - protein, 43 aa, synthetic construct
LIRLLKRLLRLWPNRVRAAKTLAMRRMGDVPLSARAMPWKIDR

SEQ ID NO: 7720 - protein, 48 aa, synthetic construct
IFRFWKKLIKKWRKRCAAQWAEYARAPEGAKIKEALDKLLAWVVAYRA

SEQ ID NO: 7721 - protein, 50 aa, synthetic construct
RIKLLPRLFRKLRHIRETISRRRERLAYAAAWETLLGLGNADAAKRKKKD

SEQ ID NO: 7722 - protein, 39 aa, synthetic construct
KLRFFRKLLKLFKNLQKMLRDARMSKLELKLGWVKKPLQ

SEQ ID NO: 7723 - protein, 36 aa, synthetic construct
LLKLIQKYFKRLKNRWRRKRLIVAKATIKLAAMGEP

SEQ ID NO: 7724 - protein, 39 aa, synthetic construct
RIKLISRFLKRMKKACLLKALCAAMRANRAGHGWNLFVS

SEQ ID NO: 7725 - protein, 21 aa, synthetic construct
YYKMLKRIMKLLRQGKALVPR

SEQ ID NO: 7726 - protein, 33 aa, synthetic construct
FIRLYRRMWRKWKSALAWSPKKCFAKLRLLYRA

SEQ ID NO: 7727 - protein, 21 aa, synthetic construct
RLRYFRRYYKRYTNKGLIAAA

SEQ ID NO: 7728 - protein, 52 aa, synthetic construct
FLKLYCKYFRRLKREKAHIYRKAAKCACLGKAAKAMKPKQNLLLTGTKKKQK

SEQ ID NO: 7729 - protein, 54 aa, synthetic construct
LLKIYRKWMRLLKPRALTKKKLCQDIPLQDRKDTLLARKRILMPARRLWILKVW

SEQ ID NO: 7730 - protein, 35 aa, synthetic construct
RFKMIQRFWRRLTKGKWAALSAPLTMWKARLARMK

SEQ ID NO: 7731 - protein, 45 aa, synthetic construct
LIKWYKKMMKKLTRKLKDFAKLTVMYAAPQCRHYLLWSKRRLLKR

SEQ ID NO: 7732 - protein, 21 aa, synthetic construct
KFRLLRRIMRWFQRHLLKAAK

SEQ ID NO: 7733 - protein, 21 aa, synthetic construct
RLKLYRRFIRLWCKLSHQHKA

SEQ ID NO: 7734 - protein, 74 aa, synthetic construct
LLRLLRRMFKFLRKYHILIKLKKQLKNDTPSASELMAMMALKNCMLRLLSREHRVLVNAARLCRALAWFRKARR

SEQ ID NO: 7735 - protein, 29 aa, synthetic construct
YFKFFRRMLRLYKREQQFLRRYLKAMGAL

SEQ ID NO: 7736 - protein, 24 aa, synthetic construct
KFKILPKLLRKIKKENVYRLLACV

SEQ ID NO: 7737 - protein, 40 aa, synthetic construct
YFKLLKRLYKRFRKQRALHRNLTAARLACSAWCAREIFNK

SEQ ID NO: 7738 - protein, 45 aa, synthetic construct
IWKLFKRYFKRISHQANKKTKRLRLMISMKLTILTLKTAVLALLA

SEQ ID NO: 7739 - protein, 97 aa, synthetic construct
RMRLLNKYFRRLRRNPAYHAACLYCKRRCKKFARRLLSKDRKRCGRRKCRLIDKAGTAAENLRKRYRRVKRLRVATLFLGHAAVLWLWVKFYWMHAL

SEQ ID NO: 7740 - protein, 47 aa, synthetic construct
MMRYMTKLLRFYQRGQKSAALRQRRRRLVHYARRDALCKLFGRSKLL

SEQ ID NO: 7741 - protein, 98 aa, synthetic construct
KLKILHKMFKLMPRRAYKALLGFHLRAKFHRRYKLALKRLYQAWRAVMTPKLKMELLLKLKAKRLDGYNRVLLLRKDDHIRGPLKNERAYAIRHLKYC

SEQ ID NO: 7742 - protein, 64 aa, synthetic construct
WLRLMRRIMRFLNKTRWPLEKGRARKATDILKAKFGKRLPWLKKCSLINKRAALTAKVSRMLED

SEQ ID NO: 7743 - protein, 53 aa, synthetic construct
LIRLMHRLLRLIKKRKAKALKKLWPCQVKRGASKAKKVIFQIRLTDRATVDSP

SEQ ID NO: 7744 - protein, 36 aa, synthetic construct
KLKFFRRLMRMFSRRALKLKTNVHLSDRAPGCKCAA

SEQ ID NO: 7745 - protein, 40 aa, synthetic construct
KFRLYRRLIKKFTKLIKEHRAEYKAYNKARRLKALMCALS

SEQ ID NO: 7746 - protein, 48 aa, synthetic construct
IYKLLPKLMKKLPHAMLAKAGLHKRPGRMGMARNAFLEKMLNIRKRWA

SEQ ID NO: 7747 - protein, 42 aa, synthetic construct
RLKLMPRFLRKIRHLWNYAETATWAMCALKCAAKLVLIKAKN

SEQ ID NO: 7748 - protein, 63 aa, synthetic construct
FYRLMRKYWRRFKKSEHRRALYPWIALKAAAPWAKCKRLRLWCKIMGLRHKKANCFIAIARKQ

SEQ ID NO: 7749 - protein, 46 aa, synthetic construct
MYRFWCKFYRLLRRAEWKARLRLAGRKPRACRLGRKRLTISELWQS

SEQ ID NO: 7750 - protein, 27 aa, synthetic construct
RFRLWNKILKRLRKALTGFHECAAVRL

SEQ ID NO: 7751 - protein, 49 aa, synthetic construct
KFRLMKRILKRLKRYMRLKARATRIEVHLAHRCTRLIVCSTCTKAEKLL

SEQ ID NO: 7752 - protein, 20 aa, synthetic construct
KWRYWHKFLKFLRTNLLMLA

SEQ ID NO: 7753 - protein, 89 aa, synthetic construct
RLRIIKKLWKYMPKNALAPKPLSMNLLAIPYREQAALDKRAARGERVNSKKHTQNWGAFARLHRKMKRKARVKQKYRLRCLAIHYRKKY

SEQ ID NO: 7754 - protein, 25 aa, synthetic construct
RLKLLQKWLRFLRSHLATLRKPHMY

SEQ ID NO: 7755 - protein, 96 aa, synthetic construct
LFRLMSRLMRMMRCIKAHKQLKYAWDRRKSAVLIIGMRTRVALALNLRKFKFYGLNLLLAYQKQLSRAARRKTYDLDMAKARAPRRIASARTICRN

SEQ ID NO: 7756 - protein, 83 aa, synthetic construct
LWKLLKRYFKMMRKQGCCAALKFKSAYTCLERYKAYRYAKLRVLTKKKQLNKRGADRHAWNMVPKKLKKLNRALYPETWRYLA

SEQ ID NO: 7757 - protein, 25 aa, synthetic construct
FLKLLTKWLRFLKRADRDFYIRRMQ

SEQ ID NO: 7758 - protein, 60 aa, synthetic construct
FWRYLKRYLKMLNKALASLCTRKGCRLMANLDYRARLKWNAFGAPVYKLKVRAAFAKPRM

SEQ ID NO: 7759 - protein, 33 aa, synthetic construct
RLRLYRKLFRKFRCVAKAAYNKFGHRMAAFCRL

SEQ ID NO: 7760 - protein, 27 aa, synthetic construct
KLRIYPRMWRKFCKLLRIRALKAIANW

SEQ ID NO: 7761 - protein, 61 aa, synthetic construct
LFKYIKKWLKLLKKKATIFPKRKFPMCRAKLLWLWVKLPYLYHCALRLLACRAPACRDKQR

SEQ ID NO: 7762 - protein, 31 aa, synthetic construct
KLKFLKKLFRKITRALHLRAAFGYPLLPRYK

SEQ ID NO: 7763 - protein, 24 aa, synthetic construct
LWKYLQRYIRMFPRARAFLSRRLA

SEQ ID NO: 7764 - protein, 66 aa, synthetic construct
FLKYYKRFIKRWRKEASAKLRALRLPLDAKRHAMKRALRAKKDMRWFMALRLLAMLWAKWKNQDKG

SEQ ID NO: 7765 - protein, 66 aa, synthetic construct
KYKLMTKLLRMYPKKLRTRLVARWLVLRPKSAYRKYAPRWLQVWLRSNRYDKYVLAKIMSLTLKLK

SEQ ID NO: 7766 - protein, 100 aa, synthetic construct
WLRFWSKLWKRFKTCSAKKAKRDAADMKAHKARKAVHRTYAKTRRDPRAVKIKMRGLRLKFSRPDQWADAFKLDKFMLKKLARKLCKERAMYTILLMCKD

SEQ ID NO: 7767 - protein, 62 aa, synthetic construct
KWKFFKRLLKRWRRIKILRKRIDLHYEHARIYAGYKIFRALIRLSCPQQAWLAALAALFLAK

SEQ ID NO: 7768 - protein, 41 aa, synthetic construct
RLKWINKFFRRLSRSHDSQHVLAAFLKKKARTLIAAGRVAR

SEQ ID NO: 7769 - protein, 20 aa, synthetic construct
RLRLFKRFLRIMCRAYAAVR

SEQ ID NO: 7770 - protein, 33 aa, synthetic construct
FLRLYKRWIKIFRRMRLLNQLQEHRLLLRDKAL

SEQ ID NO: 7771 - protein, 41 aa, synthetic construct
KFRLLKRYWKMLRKHASARAAQNTVQLNTMAALWQEKARRG

SEQ ID NO: 7772 - protein, 76 aa, synthetic construct
IFRYYKKILKRLRKKKLNAKKEAKRKDLWPQIDKSRAILQNKIPLECIALNLLYDLKRENRVWLRKLKAKTEFQAG

SEQ ID NO: 7773 - protein, 25 aa, synthetic construct
FMKLFKRFYKMYRKIATAAPLRRAC

SEQ ID NO: 7774 - protein, 20 aa, synthetic construct
ILRFLKRLWRRLTKANAVQT

SEQ ID NO: 7775 - protein, 40 aa, synthetic construct
KYKMICKLLRKLRRTVRMGRCEATYLLFAHKEDKLRFLNK

SEQ ID NO: 7776 - protein, 36 aa, synthetic construct
RLKLIKKWIRKLKRYKACFACAHCLWPLKWHKDAGW

SEQ ID NO: 7777 - protein, 48 aa, synthetic construct
LLRWIKKLLRFLPQAWNTMLIQCLGMHRKLRRQKSLKREKMGAQLRAR

SEQ ID NO: 7778 - protein, 38 aa, synthetic construct
LLRMLKRIIRKLRRLKAEAFLKMLAYDSDALHGYLKMM

SEQ ID NO: 7779 - protein, 52 aa, synthetic construct
LFKYWRKFLKILNKYKRALPLAKLKKKYRPGKAALDWLIRKNLKKLAFVAAR

SEQ ID NO: 7780 - protein, 25 aa, synthetic construct
WFKIYKKIMRLIKKHIFALLRLRAE

SEQ ID NO: 7781 - protein, 43 aa, synthetic construct
KLKFYKRMFRRLRNKARLAQQAFAMKPTAPGSRLRWLKMCRSW

SEQ ID NO: 7782 - protein, 23 aa, synthetic construct
RLKWLPRLYKLYKQSKAARHHAK

SEQ ID NO: 7783 - protein, 25 aa, synthetic construct
IFRFIRKYIRLLTHKYKLWRAERLL

SEQ ID NO: 7784 - protein, 32 aa, synthetic construct
RLKYFNKILKKLNNPNHLLRAKAAVFKYARIH

SEQ ID NO: 7785 - protein, 25 aa, synthetic construct
IIRLLCRLLRLFKKDYLSKNNNDAL

SEQ ID NO: 7786 - protein, 41 aa, synthetic construct
ILKFLTRLLKRFKHRHVCHHLLRRRLATLVAPRRLRSKMQG

SEQ ID NO: 7787 - protein, 50 aa, synthetic construct
RYKFYPRFLKYYKSARKKRDCTDYKLSLRKEADLNLYLARQQLLLKVLKK

SEQ ID NO: 7788 - protein, 32 aa, synthetic construct
KLRFWQKLMRKIPKADTAYLKKEASAKRSNAI

SEQ ID NO: 7789 - protein, 58 aa, synthetic construct
RYKFMKKLWKFIRRRLVDRKRAPTVAIKCLPRARTKQLACNPLGQTKDFAAASLYLRK

SEQ ID NO: 7790 - protein, 67 aa, synthetic construct
RLRIWKKYFKRLQKRKLEAILFDMDAMNPTWASIALYLRGRWALAKAKKASLKMLCSRRPPGAHRNA

SEQ ID NO: 7791 - protein, 28 aa, synthetic construct
IWRLWRRLLRRLRSTYAKDECKPRALTP

SEQ ID NO: 7792 - protein, 38 aa, synthetic construct
WLKFLPRFYRLLQSIAPKRAKKKEAFKDQKKMLVIKAA

SEQ ID NO: 7793 - protein, 59 aa, synthetic construct
WWKLFRRLFKRFKKLLAALIRMALQRKLYRHKLLRLPSFCQAVDALAKKCKSVQYLNGR

SEQ ID NO: 7794 - protein, 41 aa, synthetic construct
KIKLWRRWFRRWSKRALARPWMNRKVKAAPLKQACVLACKM

SEQ ID NO: 7795 - protein, 67 aa, synthetic construct
RMKMLRKIIRRLRKVRKLRLDECAWRCMWKKLHVRSDLHAYLWARPKIALDCYIRKYAKLPRRALKA

SEQ ID NO: 7796 - protein, 34 aa, synthetic construct
LLKLLSKLFKYIRKKRNLHRQVFMKLYAQQRRKA

SEQ ID NO: 7797 - protein, 29 aa, synthetic construct
RWRIWQRLIRKFRSLHAKLWANDRILRQA

SEQ ID NO: 7798 - protein, 33 aa, synthetic construct
LLKWIRKMFKKWQPSARKAGAIQMRLFLKALRG

SEQ ID NO: 7799 - protein, 62 aa, synthetic construct
KLKLFRRFFKRYRCHKGLLKIRRKDSYQTKVRLRRAHWHANQKRIWNLTSLLLRVASLVALR

SEQ ID NO: 7800 - protein, 45 aa, synthetic construct
YWKLWRRLFRMLQQKPDKFIKAVFLARRYKLLKLKLCHRAVRPSE

SEQ ID NO: 7801 - protein, 64 aa, synthetic construct
RYKLLKKLFRRWNRFMATKQVGHAFMRTILKNAAKKARFHAVLIQFKALRLCGKPYRNLARLKL

SEQ ID NO: 7802 - protein, 48 aa, synthetic construct
KLRLFCRLYKLYKHAAERKWKQSTKSIKPELNLAHKLPLQKKAEQSRK

SEQ ID NO: 7803 - protein, 24 aa, synthetic construct
MLRLLNRLYKKFHSLEKLLVRRMR

SEQ ID NO: 7804 - protein, 43 aa, synthetic construct
KFRFFRKLIKYIKNRAGYAACKAKSHAKLAYAALRRQRRKEPQ

SEQ ID NO: 7805 - protein, 30 aa, synthetic construct
RWKYLTRLIKYFRKCLALHSKPALRSTSKA

SEQ ID NO: 7806 - protein, 21 aa, synthetic construct
LYRFLKKMLRLLKRYILNLRS

SEQ ID NO: 7807 - protein, 43 aa, synthetic construct
LLRMWKRIYKKIRRALAAAKTKLIFKRLLLVQHMAYRTKANEK

SEQ ID NO: 7808 - protein, 33 aa, synthetic construct
RFKILKRWWKKLSKAFRTAWLKMDVAKWAHARD

SEQ ID NO: 7809 - protein, 52 aa, synthetic construct
RWRWFRRWLKILKRFWALRHLQAMYCAMYLFLKFYGKLAMAAKKTRRKETRL

SEQ ID NO: 7810 - protein, 36 aa, synthetic construct
LLRWLKKFMKRYNKACLMAAALSGKCCQNQASRDRR

SEQ ID NO: 7811 - protein, 36 aa, synthetic construct
RLRFYTRFFKRFKKKAQVVFKPALLDAKALALDRPE

SEQ ID NO: 7812 - protein, 43 aa, synthetic construct
LIRLFKKLIKRIRRPELASAQPLRLERYLWYNTKLKRKHKCET

SEQ ID NO: 7813 - protein, 35 aa, synthetic construct
WLRMLCKFLKKLPKKKALSAHAKVDWKVWRFKGTA

SEQ ID NO: 7814 - protein, 52 aa, synthetic construct
FLKFIKKLLRKMRKLYRPGLKPCNKHAANLLRCDLWAIRHRKLVQKATLKKN

SEQ ID NO: 7815 - protein, 24 aa, synthetic construct
WLRYLKKLYKLWNNKILLTCERLL

SEQ ID NO: 7816 - protein, 60 aa, synthetic construct
MIRMFKRILRRLKQFAANLENLRAAYDELTALSRFAKLDNQGLQNGHKWLRHKFKALRKK

SEQ ID NO: 7817 - protein, 20 aa, synthetic construct
RMKLLPRFLRFIKTVAALKA

SEQ ID NO: 7818 - protein, 43 aa, synthetic construct
FFRLMRKLLKKFKKYGFEADAVAASCYKCREKALTRKWWLLHL

SEQ ID NO: 7819 - protein, 55 aa, synthetic construct
FYKLLSKYLRMLKKHLYYWIAAQYSRALLYRKHAKLAHSLRRRNRAKDGAERLRQ

SEQ ID NO: 7820 - protein, 32 aa, synthetic construct
RLKLLTKWIRLYRRYRLLKAPAVSHLARMLVV

SEQ ID NO: 7821 - protein, 69 aa, synthetic construct
FFRYYRRILKKIRCTPDRDVKKILLARKKARVCGQLTRKFEHLAALRKRALEHALLRYRDKKLRNVAQV

SEQ ID NO: 7822 - protein, 20 aa, synthetic construct
FFKLYRKFYKLFRHDSRLAL

SEQ ID NO: 7823 - protein, 98 aa, synthetic construct
KFRILKRLFKWLNKLMLQYALCAGKMAKRKWKLTAAQALLKEKCFFCFKRGNSAEYWAALRKRGYLKLKKAMAECSCAKSMLLARCMARKTGHRIDWG

SEQ ID NO: 7824 - protein, 23 aa, synthetic construct
RWRLMHRLLRKLCRKPRGALRAI

SEQ ID NO: 7825 - protein, 43 aa, synthetic construct
FMRLWKRFYRLFCKFRLFKKLRAMLKAWLRTARRLRLNQMLHL

SEQ ID NO: 7826 - protein, 66 aa, synthetic construct
YFRFLRKFFKKLKKARRKSCAIAQWGSTYNKKLNCIKKARRRLPKQYAATADAERLAKRELLKVAN

SEQ ID NO: 7827 - protein, 80 aa, synthetic construct
KLRIWNKLWKRYTRYATKMIKEDWAARRDFKAQPIRRQAPALGRKLLRIAAAKPNNLEHFSRKSIGRAAEGKLGYLKLLL

SEQ ID NO: 7828 - protein, 32 aa, synthetic construct
RYRLIKKWYRFLRRHKHVVKQLKLNLLTAAFD

SEQ ID NO: 7829 - protein, 49 aa, synthetic construct
ILRWLRRIFRLFRKAAPGLNRNCIELALAAKRLNCGAARTRILHKRAHR

SEQ ID NO: 7830 - protein, 61 aa, synthetic construct
KMKYLRRFFRRLHNHCPKAELAFCWYLWKKIKKKLCLAAKRAYALLARTLAECYMKTRTML

SEQ ID NO: 7831 - protein, 48 aa, synthetic construct
KWRLYHRFLKRMKQGRRKCVMYALALRALLVTCYARSNLFRLLSLIYA

SEQ ID NO: 7832 - protein, 31 aa, synthetic construct
RLRLFTKLMKRLRRDCINHWLKAKTNLALEI

SEQ ID NO: 7833 - protein, 45 aa, synthetic construct
RLKLLRKMFRMFKKEWRADRDFYFAKKWIPWAAAPLLGKILHCAL

SEQ ID NO: 7834 - protein, 53 aa, synthetic construct
MIKLLKRMFKRLKQNPRGNHKRRLLAYRAWLPHYLLQSAKPATYAKEIKKRHK

SEQ ID NO: 7835 - protein, 46 aa, synthetic construct
YYKILKRFFKKMRRARCLFLLRYCAIAVAYAKRAKAAKQSDTVDSK

SEQ ID NO: 7836 - protein, 60 aa, synthetic construct
KLRIFKKLFKMLRTVRNNRARFARDSVKWQAYQDFRDLRKFRKLAHVSLSKLATARLGTA

SEQ ID NO: 7837 - protein, 33 aa, synthetic construct
RYKMWKKIMKKYPNLRAKSLKLWACATLAVAKT

SEQ ID NO: 7838 - protein, 66 aa, synthetic construct
RLRLYNRMFRKLKKAVPDARQLIAKHLYRHLMVKARLKRLHAGLDYGRCSLKIKRDQPAINWRKKI

SEQ ID NO: 7839 - protein, 29 aa, synthetic construct
RIKFWHKMWRFLSRYPKALAPCRLKKAMA

SEQ ID NO: 7840 - protein, 47 aa, synthetic construct
FFRFLCRYYKRLRKLLRLPARHAARALHCLRIRKQQKRVLDKAKHTT

SEQ ID NO: 7841 - protein, 22 aa, synthetic construct
YLKFLQRFYKRLTRRHAARAAA

SEQ ID NO: 7842 - protein, 75 aa, synthetic construct
LFRLFNKFWRLYKSLRLKSKTAKLALRSRATYEILYLILMAKKFKKAKWTKTRHAPARHRTKKLNFKAALLRSPG

SEQ ID NO: 7843 - protein, 26 aa, synthetic construct
FLRLLKKIYKKFRNLKAMLPYDAADM

SEQ ID NO: 7844 - protein, 46 aa, synthetic construct
KLKWMPKWLRLLKRKRRLQSRVSAMLKRPRLFDRALVVKYEAWCCD

SEQ ID NO: 7845 - protein, 20 aa, synthetic construct
KWKLLKRLLKWLSRWAGKHT

SEQ ID NO: 7846 - protein, 38 aa, synthetic construct
LMRLFPRFIKKLRRAAELVRTEHLYRDYLLKRRCFHLC

SEQ ID NO: 7847 - protein, 74 aa, synthetic construct
MLRLLQKMLRRMKRFMPGLVRKPETYLQYLCLTLAYKKPLKKLRKLREKRQNKKAIMRAQAHATSARPYHLAKA

SEQ ID NO: 7848 - protein, 41 aa, synthetic construct
FLKFLRRLFKKYTTLKMSQWNDLFRLWDRARALLFWKRRAL

SEQ ID NO: 7849 - protein, 27 aa, synthetic construct
YLRWICKFYKRLQSGDALWLRRRLALF

SEQ ID NO: 7850 - protein, 47 aa, synthetic construct
RIKWLKRMMRMWRTAAHALRQLANGAADAAAKRKRRDMWTMWNDLAT

SEQ ID NO: 7851 - protein, 35 aa, synthetic construct
KLRWWNRMLKFLRKALRMKNDFVLAWAKVVPRKPL

SEQ ID NO: 7852 - protein, 24 aa, synthetic construct
RLRLFKKLLKLFTKIDCFKKFALQ

SEQ ID NO: 7853 - protein, 38 aa, synthetic construct
FLKLYSRFLRKFSRCKKKLEAKWDMFKLAAKCGLPTHA

SEQ ID NO: 7854 - protein, 37 aa, synthetic construct
FFRYFRRLWRRLCRQRKPLHLALCAYRLQRAFQNLRR

SEQ ID NO: 7855 - protein, 42 aa, synthetic construct
RIKLLKKLLKFFKSGLDKLEKSHVWKLWGTNRLTDLLKNKRA

SEQ ID NO: 7856 - protein, 39 aa, synthetic construct
RLRLLRRMIRWLNSRRAELRVASAEAQVKMKQAGRQPNL

SEQ ID NO: 7857 - protein, 56 aa, synthetic construct
LLRLLCRLMKRMHRYTLRHAQLIYLPKRRWWRAAFKDCKVRCALASRLKHHKASSL

SEQ ID NO: 7858 - protein, 60 aa, synthetic construct
MWRWFRKWYRRLNRGRRKRNAPPTFLKLEEKAEALQLARIYKKDVFWRFLLAKKLLLKAF

SEQ ID NO: 7859 - protein, 82 aa, synthetic construct
LLRIWTRMLRKMRTLKRLLLARYRVTRHKNARARTHCKKAKWNVILAKARAAGEAMEKAAFVCKKRGGLKILLSPMRTFLHV

SEQ ID NO: 7860 - protein, 98 aa, synthetic construct
KWKWMCRYLRRWKRIKTWQQTNAAALRLDLAPALLRRFKMLTWYADYRRNLRVLLFRAKGHFKLLGAKYKYAMQPRRAKPHLEAARHRMQQDLIRYAR

SEQ ID NO: 7861 - protein, 31 aa, synthetic construct
RLKLWHKLFRFLQKFPTRRLKAALAKRTYAR

SEQ ID NO: 7862 - protein, 58 aa, synthetic construct
KLKILRRLLRLFCRHYKHNLARECYKQRFRGARTASSFHSIGKTAVRRMLGKKALLAF

SEQ ID NO: 7863 - protein, 48 aa, synthetic construct
RWRWYQRLMRMIKKFLVALGLKHIHKKELRLALLAVLRVYADPMARAV

SEQ ID NO: 7864 - protein, 31 aa, synthetic construct
RYRLFTRLIKRLQRRMFAAYSKRARTADAQV

SEQ ID NO: 7865 - protein, 69 aa, synthetic construct
FLKLFSKLIKMLRRMRCDDLDLFRKKALMSMAALKRGDKPLKANRMMKKQKNRAVQWIAYWCLKANKEA

SEQ ID NO: 7866 - protein, 66 aa, synthetic construct
MFKLLNRFIRRWPKVQAAALLLRPKCARVSYCRSPNRRANAALLAAPGAKHKRLREKAANECDAKT

SEQ ID NO: 7867 - protein, 61 aa, synthetic construct
FWRFLSKLIKFMRRKLYLDAQRDLTKLLLKKDRALLKDRAIHKQSKPCLRARAQMKKRKAM

SEQ ID NO: 7868 - protein, 51 aa, synthetic construct
WLKLYRRYLKILRRLMYALRGLGMRAKWYRRKELIVMRRDVANCKRLGAIQ

SEQ ID NO: 7869 - protein, 51 aa, synthetic construct
KIKLIKRWLKLMKQLFKARRRRICLFCLPAANALQFLIALVSRLLSQTGAT

SEQ ID NO: 7870 - protein, 60 aa, synthetic construct
RLRLLRKLFRLMRRGHHWAAQAEIERVLLYSREFKCFAFIKFNRDLRLARRCKNLFLKKR

SEQ ID NO: 7871 - protein, 72 aa, synthetic construct
LLKLLNKLIRKLPRPAWFGIQAHWAWRNQCKAAKMVHARQAWNDRNLYKFHLKAKLGRRGRKIKSALLRLQG

SEQ ID NO: 7872 - protein, 22 aa, synthetic construct
ILRLLRRMMRKYRKAGPFLRWL

SEQ ID NO: 7873 - protein, 23 aa, synthetic construct
RWKLLQRIFKWFRPRTLELDRLL

SEQ ID NO: 7874 - protein, 38 aa, synthetic construct
KLKLFRRLFRFLSPKLLAKGNAYKWMYLCVVKNKTRIK

SEQ ID NO: 7875 - protein, 51 aa, synthetic construct
RLRLFKRYFRRICCCRRLQAAGWERDLKNAAKLACKKLPARIDGLAGANWG

SEQ ID NO: 7876 - protein, 42 aa, synthetic construct
RMRFFKKLLKKFQNYRFELFLDRLAKLLLLLMAYKARGEGAA

SEQ ID NO: 7877 - protein, 35 aa, synthetic construct
KWKLWKKIFRKFCHPAKLKAVSLLTIGLLKKRELP

SEQ ID NO: 7878 - protein, 20 aa, synthetic construct
LLRFIRRYFRLLQKTKNQNL

SEQ ID NO: 7879 - protein, 58 aa, synthetic construct
KLRLFHRIFKRYKPRRKKKANIARAPMMKMLWAQPRALALLWKTYRNLHPYRWGLRDW

SEQ ID NO: 7880 - protein, 45 aa, synthetic construct
KIKYLKKFLKIFCKIALKAILGQKVDWRSKFKNTTLWAALRLMKK

SEQ ID NO: 7881 - protein, 20 aa, synthetic construct
RFRIFTKFLRFLSRARNLCA

SEQ ID NO: 7882 - protein, 50 aa, synthetic construct
RFRLLTKWLRRLRTGREPRAATLNFRAQRANFFMADKFKLKDAKELRTTR

SEQ ID NO: 7883 - protein, 35 aa, synthetic construct
KLKLLRKLMRFFCKTFLFHKCLKKRRNRAGAALTL

SEQ ID NO: 7884 - protein, 82 aa, synthetic construct
KFRFYPRWMKRLKKVLRAKMKQKAHGGRCWLLLAIIPAEVALRLKKDEEDLALLLSRVELKKKVPLALAKWCLFMQLAFAYK

SEQ ID NO: 7885 - protein, 29 aa, synthetic construct
KYKLMKKLFRLLRQLALLRMKRRLKHLVP

SEQ ID NO: 7886 - protein, 28 aa, synthetic construct
RMRLYRRYFKKLPNRAHKVLKIRWLAAA

SEQ ID NO: 7887 - protein, 31 aa, synthetic construct
FMRLFRRILKRLKKFPCKRAAATHEAARLRV

SEQ ID NO: 7888 - protein, 49 aa, synthetic construct
KMKYWHKFFRLIQKLGHAKANLNDILILKKVKAKRLKHLKASDRGRAAN

SEQ ID NO: 7889 - protein, 20 aa, synthetic construct
LFRLYHKIFKKLKQLKFLAV

SEQ ID NO: 7890 - protein, 31 aa, synthetic construct
RMKLIRKLLKKLRHKACQRVAKYRFAADAAL

SEQ ID NO: 7891 - protein, 25 aa, synthetic construct
LFKLWQKIMRLLKSLKACPLNATKE

SEQ ID NO: 7892 - protein, 24 aa, synthetic construct
RLKFIKKLLKKIKRAACANKALAA

SEQ ID NO: 7893 - protein, 35 aa, synthetic construct
YFKLWHRMLRYMRKTDQLSLAKYKLAVRGEARAKA

SEQ ID NO: 7894 - protein, 20 aa, synthetic construct
LLRIYTRWWRKMKKKWGLAA

SEQ ID NO: 7895 - protein, 20 aa, synthetic construct
RLRLMKKIWRLLRQMLAVSC

SEQ ID NO: 7896 - protein, 25 aa, synthetic construct
LLRLFTRLLKRYKQGNKRKYKLAYS

SEQ ID NO: 7897 - protein, 52 aa, synthetic construct
RLRWLCRLLRFISTKAARRGLKLHKLSAHPPTEPKRVCLYRANWEKAKFKAS

SEQ ID NO: 7898 - protein, 37 aa, synthetic construct
RFRFMCKFLKKLNRCAKRAASRLLLHARHVTHALEGW

SEQ ID NO: 7899 - protein, 67 aa, synthetic construct
MYRYLPRLWRRMKRVKKRKMRAAAYRKTDNRRPLMKMKQARAALQYATLLALVAWLPYKVKDYKYAD

SEQ ID NO: 7900 - protein, 29 aa, synthetic construct
RLKMLKRLLKLYKNCLVMYRGTHKMTTRL

SEQ ID NO: 7901 - protein, 51 aa, synthetic construct
ILKMMPKFLRKLKRLLKRRYPGTAEPRDLRRKLRRIVLKLLIVRAHHKTLH

SEQ ID NO: 7902 - protein, 47 aa, synthetic construct
YLKFLPRLLKKWSKLLRCRVRIKFAVKLFFILARSEFGRAYRYHAKW

SEQ ID NO: 7903 - protein, 21 aa, synthetic construct
YLRFYHRLMKRLRKKAADGFL

SEQ ID NO: 7904 - protein, 57 aa, synthetic construct
ILRLFKRLFRKWNRLRRRQFARLYARDYLQRKLAECWKAEMSMACREAMTLHRMKKH

SEQ ID NO: 7905 - protein, 62 aa, synthetic construct
RLKWFKKILRLLSKRPISLLLAKKAAALQDVKYFKWMICKKARKAAYCCRFEKTLETNAGLD

SEQ ID NO: 7906 - protein, 27 aa, synthetic construct
KWRWMKKLWKFLQKRLLRATRLATHIS

SEQ ID NO: 7907 - protein, 20 aa, synthetic construct
KLRFYHKIYKLLHSLARTKR

SEQ ID NO: 7908 - protein, 47 aa, synthetic construct
RMKLMPKFLRFWRRTALAAREMEACQALRGALYTNKERGYAQAAKLR

SEQ ID NO: 7909 - protein, 59 aa, synthetic construct
RLKFLRRFMRKFKHFKAAAALAKSKNNCPCAAALFSKRPSASCPVQKAKRLPNLERMLK

SEQ ID NO: 7910 - protein, 37 aa, synthetic construct
FLKMLRKFFKRFRRAHAYDKEALLWRLRAAWGICPAK

SEQ ID NO: 7911 - protein, 77 aa, synthetic construct
KMKLLRRLWKFITRLWVMGKLKHKALHQLVLGPIQKKLRHRSRSKKKFQKDCHRAAALLRFLWWMREKWKLLSGAQR

SEQ ID NO: 7912 - protein, 38 aa, synthetic construct
KLKILKKYYKLIRKIKANARAWMRLLLNRHNWYANVKL

SEQ ID NO: 7913 - protein, 29 aa, synthetic construct
RIKFWQRFLRLIRNALKAKRYTKLQMNAT

SEQ ID NO: 7914 - protein, 43 aa, synthetic construct
RMKLIRRLIKLMRKRVFPWRLSALTLKDLALYRLVRNSEETLK

SEQ ID NO: 7915 - protein, 60 aa, synthetic construct
LYRYFRRWWRRFNKRPCRMLKMAQRKLSLALKSKRSTEAKAVSACLRKFAAEIVIRLAKH

SEQ ID NO: 7916 - protein, 26 aa, synthetic construct
KIKYLSRLLRLYRHLFYRRLRVRRLL

SEQ ID NO: 7917 - protein, 73 aa, synthetic construct
LIKYIKRIIKRMKKLARKRSGRRPTLRLACAELRCEPIRPDAALWALAKKRGMVNRILKHYAVLLRFTPAGYK

SEQ ID NO: 7918 - protein, 76 aa, synthetic construct
FWKFYHRLFKLFRREKFFLLVTRLDVLRLEGNFHKPALRGKQLGLRRNELKRMFKLAKYAKFAWLMAAPALKANAV

SEQ ID NO: 7919 - protein, 80 aa, synthetic construct
RFRLIKKFMKRIKCIDLLLKKHAYAIAKAPLRKVMDMFLATKWYTLAARAALVAWLATRHDAMTGILVFRRAKIFAQARA

SEQ ID NO: 7920 - protein, 46 aa, synthetic construct
KLKFMNKIFKYFNKARPLATLSADDKQRLKAALFKKDWERKLGRHR

SEQ ID NO: 7921 - protein, 29 aa, synthetic construct
RLRLLHRLFKRLRKCLRTVALPKRARNAP

SEQ ID NO: 7922 - protein, 58 aa, synthetic construct
KFRFLKKFFRRLRNKTAWAHLALLGICTKLVSAASSKVIKCHKEALRTRCRRARKKGH

SEQ ID NO: 7923 - protein, 37 aa, synthetic construct
FLRFLSKLLRKLQKCHKSRAMTARAQALRLKAKSSSF

SEQ ID NO: 7924 - protein, 50 aa, synthetic construct
RLKMFKRYFKRMKRCYILFALKYKAYQLTTKERALKDLLLLFWLALSGSI

SEQ ID NO: 7925 - protein, 29 aa, synthetic construct
KWRILKKLFKLWPKYRKRVANALRTIPAL

SEQ ID NO: 7926 - protein, 29 aa, synthetic construct
LYKLLRRMIRLYKRRKPNNLALQYCKLLA

SEQ ID NO: 7927 - protein, 28 aa, synthetic construct
LLRLLKKFFRFLRKTCYILLPKCILRLE

SEQ ID NO: 7928 - protein, 60 aa, synthetic construct
KLKLLRRMMKKLNRWGATAKPKIPTQALWDNWSCDGWRRAQRRRARLKRLLVRNHFRCAA

SEQ ID NO: 7929 - protein, 39 aa, synthetic construct
FFRWIKKLMRRMSRARILRRYAADAKGAGPPHFELLLRA

SEQ ID NO: 7930 - protein, 37 aa, synthetic construct
RMRFLCRLFKKWPRTAKLNLRDQAKCLFRAFQPMLKA

SEQ ID NO: 7931 - protein, 40 aa, synthetic construct
RIRLYSRLLKKLHKKLAGLKMDKRRCAMRPKADQGLGYGH

SEQ ID NO: 7932 - protein, 69 aa, synthetic construct
KFKYLPRLMKILTPALAPAGIRLLRPLREPAMKRKRHLDHKLRWRWVACAANIHRHLCDAELFDKARFL

SEQ ID NO: 7933 - protein, 20 aa, synthetic construct
KYRLFRRMLKYWKSKALLVV

SEQ ID NO: 7934 - protein, 48 aa, synthetic construct
RLKYMRRLLKMLCRHREKNRREPALAVLAAERGLRRKAPAPYAFRYHR

SEQ ID NO: 7935 - protein, 34 aa, synthetic construct
KLRMMRKLLRRWKNMLQQDTLLLAHRLIAKKVDY

SEQ ID NO: 7936 - protein, 44 aa, synthetic construct
LLKYLPKFLRKLKKFDAPFKLLARLFYKKEIRQKDKLRAFACCV

SEQ ID NO: 7937 - protein, 26 aa, synthetic construct
WWKLLTKLFRRWSRLKPMALALKNKN

SEQ ID NO: 7938 - protein, 49 aa, synthetic construct
RMRFFHKLLKLFRNAHRAAVAAMAKLLRKRVLDLRGMILKHKVMYDLMW

SEQ ID NO: 7939 - protein, 36 aa, synthetic construct
KYRLFKKYLKLLCKKRSLKADWLGMYKVKLNALHYY

SEQ ID NO: 7940 - protein, 43 aa, synthetic construct
RLKLFKRWIRRLKRLSKCCRKAGWARRRNLLILVPLIARGTAR

SEQ ID NO: 7941 - protein, 31 aa, synthetic construct
LLKLWRRWLKILRKLIAFLLKHKWVKKCKAS

SEQ ID NO: 7942 - protein, 24 aa, synthetic construct
WLRFYRRFIRRLKSAAKHQLLRAW

SEQ ID NO: 7943 - protein, 21 aa, synthetic construct
KWRWLHRMLRLYNKLSAKDLE

SEQ ID NO: 7944 - protein, 32 aa, synthetic construct
RWKLLSKLLRLFSCHKSRKNHFLLKRKAEFAV

SEQ ID NO: 7945 - protein, 46 aa, synthetic construct
KFRLLSRLMRILRPKAEKMKLLKAFDWLKSWRDLFRKELAPSGPLR

SEQ ID NO: 7946 - protein, 44 aa, synthetic construct
RMKFYRRWIRRLTRARADALWQATEAAKCCAPLRFARPLADKCW

SEQ ID NO: 7947 - protein, 36 aa, synthetic construct
FLRLFSRFLRLYKHKCLQAARVDKRLAVTRGKFCVR

SEQ ID NO: 7948 - protein, 78 aa, synthetic construct
FLRFITRLFRKFRKALRMKLKLKVLLLGKAKAKPLRKRKSPCAVMARGECQMEAKRQKHAFYAWNDQNACALIRELYE

SEQ ID NO: 7949 - protein, 52 aa, synthetic construct
LYRLWRKFLRKLPPKLLRIAWRLGPKYRRKYLQADQSKEHLGLAQKLLKLKL

SEQ ID NO: 7950 - protein, 56 aa, synthetic construct
KLRFLQKYLKRIQTKKRELQPLKIIKKFRKCHYMLWRLLLKRIYAILDAAEHILAP

SEQ ID NO: 7951 - protein, 69 aa, synthetic construct
LIKFISRLLRKLRKLKYMKIAMLVAARAAVSLRNKKSYKDFHVRYKPNLAKRRQFTWRIVLHSAIRKHK

SEQ ID NO: 7952 - protein, 42 aa, synthetic construct
LWKLYHRLFKLYHHLRRWLGPLKKWIVLKRAKVALHRTWLHR

SEQ ID NO: 7953 - protein, 32 aa, synthetic construct
RLRFMRKYLKLIPQYAALLKDKNLRIEVDRML

SEQ ID NO: 7954 - protein, 24 aa, synthetic construct
LFKLIKRWMKLLRNTERKAALYTR

SEQ ID NO: 7955 - protein, 31 aa, synthetic construct
KFRWFTRLLRYIKRDILYLKKLMEFAARLNK

SEQ ID NO: 7956 - protein, 40 aa, synthetic construct
LLKLLSKIMKRFKKAATSKRLALKWVGMKGGIRSIRGVNL

SEQ ID NO: 7957 - protein, 31 aa, synthetic construct
RLRLFRRFMRRFNPLRINLARTALRRPEAKL

SEQ ID NO: 7958 - protein, 34 aa, synthetic construct
RIRLMTRFMRLLKPSIGLKVLWDRLLRAKAKGAK

SEQ ID NO: 7959 - protein, 66 aa, synthetic construct
LMKLWHKMLKLFKKKMLRKAHTLAAAPWVATHTNKRLRYRKVFALFAKRKCKLNMNKHQAQAARMK

SEQ ID NO: 7960 - protein, 22 aa, synthetic construct
RWRFYSKLLRRLRHAWLRIGML

SEQ ID NO: 7961 - protein, 87 aa, synthetic construct
LWKILHRFLKKFCTIHANDMRKDVGMDRARAAARNKTCNALAESLIIAKMKKGKSKKNEATAQKRVYGKLRLARLWLALALPYKARS

SEQ ID NO: 7962 - protein, 45 aa, synthetic construct
LMKIYKRLYKLLRTKLKNLVESCLLYRLLVHKRKYNCAAQAWGAK

SEQ ID NO: 7963 - protein, 74 aa, synthetic construct
RFKLLSKLWRKFCKPNLGHYLAKPFCLIARNTHRRAKKVLLLKAACLSHASRDCKIHATRRWCAKCKVKRAAAS

SEQ ID NO: 7964 - protein, 85 aa, synthetic construct
RLKLIRRWLRLFKTGAYARCRHRGRQRALKVLRGRRLEQNLKLLQKMLALMEDLLCALDGRNGVRKDSCKKQKLGWKFKYLAPAH

SEQ ID NO: 7965 - protein, 72 aa, synthetic construct
KLKLLKKILKLLRSKLFWCLWYPKAIERSRLYKHALAVRRHAALLLKTAAKLNSMTTASIFKHHMRWAANLR

SEQ ID NO: 7966 - protein, 45 aa, synthetic construct
KWRLLRKLLKKFHRPVCARATMRANWKMYMNMLQAATGLYKIKLR

SEQ ID NO: 7967 - protein, 23 aa, synthetic construct
RFRLYKKLLRKFSSKAWSRAVAS

SEQ ID NO: 7968 - protein, 59 aa, synthetic construct
KFKLLRRLLRLIKKALRYYGACRLECRKAAWQTTKWAMLAGWAHFRRADFNYHKKASRD

SEQ ID NO: 7969 - protein, 25 aa, synthetic construct
RLRWYKRLLRRLPRRKDLFKTALLH

SEQ ID NO: 7970 - protein, 90 aa, synthetic construct
KLKMYKKLLKKFKSSSLRRKKCAVGKNKRVINHLEPKRLQQLVDKKGRNVMLRYAWAGLRLPGWIYLKKLQAKNKLKKDNLVNLLDAKKR

SEQ ID NO: 7971 - protein, 24 aa, synthetic construct
MLKLLTKLYKKFKRYLGVMARRGM

SEQ ID NO: 7972 - protein, 42 aa, synthetic construct
KLKIFSRFLKLFKKCPLKRLLSLRIRLMRVNALILTPSKRQL

SEQ ID NO: 7973 - protein, 45 aa, synthetic construct
IWRFLNRYLRLWKTRLAHRLPCKKAADDPLMARTTVRLLAKVLMT

SEQ ID NO: 7974 - protein, 46 aa, synthetic construct
KYKIMRRLLRKLKTQKKDNWAIAALADEHLPSFLRVRKHAANPHLR

SEQ ID NO: 7975 - protein, 60 aa, synthetic construct
KIRYLKKLMRKFRCTRTKLAGLYRHAERTMFWTWKKELAAADALALANYKDKDGKKLWTC

SEQ ID NO: 7976 - protein, 26 aa, synthetic construct
KLRLFKRIFKRMRRLYRLWQLLVTPL

SEQ ID NO: 7977 - protein, 76 aa, synthetic construct
FFRFLNKLYRRYNRREHLKIMPADLETLLCKGRLRAWFRWRCAADKYRLSSGKRLAEAAKSSKNAKFQRLYAERKA

SEQ ID NO: 7978 - protein, 42 aa, synthetic construct
IYKMWKKFLRKFQKGERQAALRSALREATKLRRAKLQRHLEQ

SEQ ID NO: 7979 - protein, 35 aa, synthetic construct
RMKFYTKWFRLWQRKMRKAMLPALKCAAVKLAAVR

SEQ ID NO: 7980 - protein, 28 aa, synthetic construct
MLRLWNRLLKKMRTLPFNAFIKQARAQL

SEQ ID NO: 7981 - protein, 65 aa, synthetic construct
YWRIYPRMMKLLNRAHEYERRCRARAMLRRYDASAKAKNKLMRKKGLPLALMFKMKSAQRLKIRR

SEQ ID NO: 7982 - protein, 71 aa, synthetic construct
LLKLMKKWLRLFRSIVVPRARDVCCKKEAAKKTKRMQEARDILQALQGLARDRSAVHAFAKKIVAKEWRAR

SEQ ID NO: 7983 - protein, 27 aa, synthetic construct
LLKLIRKLFKYIPKHRRASRAWCRLLL

SEQ ID NO: 7984 - protein, 51 aa, synthetic construct
RIKLWKRMLKRLKRKLAAAHCHAAIYRMRRKNALLHINCVSWRRSDRRLDS

SEQ ID NO: 7985 - protein, 53 aa, synthetic construct
KLKMLKKWLKRYRHAAFLRFHELPNQVYLILKFYKRGFAVLRLKLWNYTKRKK

SEQ ID NO: 7986 - protein, 43 aa, synthetic construct
RIRILKRWFKFMPKLQMLLKLRKAAKYQLYNKRDWEALKVWDL

SEQ ID NO: 7987 - protein, 56 aa, synthetic construct
RYKYLTKWMKKFSKAAKNQPSALTCRLSNRARTGIKAKQWAARKKEMFRLCALKLY

SEQ ID NO: 7988 - protein, 24 aa, synthetic construct
IFKFFRRMLRFLNREIARLTRLAA

SEQ ID NO: 7989 - protein, 36 aa, synthetic construct
RWKLLCKYMKKLKRKDAHEFQKWAILYGLSALRLWL

SEQ ID NO: 7990 - protein, 22 aa, synthetic construct
MLKFFRRLMRWLKKHAAPKWLN

SEQ ID NO: 7991 - protein, 60 aa, synthetic construct
LMKWYQKMWRLLSSAQAKKAAPAQNKDAQKKRQAQTLNKLKDGKLNLRHRKLELRTIVAE

SEQ ID NO: 7992 - protein, 24 aa, synthetic construct
RWRYLHRLYRRLRPAVIHRDASLA

SEQ ID NO: 7993 - protein, 66 aa, synthetic construct
LFRLFKKLYRFWHKRLHDMSHARMPRERLRACRYTDIKRLLNAKRQFTSLYFRVILLAKLAKRRKE

SEQ ID NO: 7994 - protein, 23 aa, synthetic construct
FLKILRKLWKYLTRKHKLTVCAR

SEQ ID NO: 7995 - protein, 62 aa, synthetic construct
IMKFWCKLWKRFCPRKLLFARYLPESRFRRKYRARKRCMKQAHAKGALARAIALCCGQLARC

SEQ ID NO: 7996 - protein, 43 aa, synthetic construct
LLRFLPRLLKLFRRKINLLRAILKLLKKMMRLKKAGTLKFKIP

SEQ ID NO: 7997 - protein, 37 aa, synthetic construct
KLKLLKKYFRLLKQHRGWARYRALAAALRWNVLAKHF

SEQ ID NO: 7998 - protein, 30 aa, synthetic construct
RLKMFRRWLKRMKKKNAHKGLFLEAIYAHL

SEQ ID NO: 7999 - protein, 51 aa, synthetic construct
KYKLLKKLMRYWRNRMYRLIRAASLVKLKRKLRGCLELDAEPAFLPLTHPY

SEQ ID NO: 8000 - protein, 23 aa, synthetic construct
RLKLFCKWLKRLHRSNLFYLELK

SEQ ID NO: 8001 - protein, 30 aa, synthetic construct
LLRYFSRWLKKFQKLAGLPLKTKARKLLTV

SEQ ID NO: 8002 - protein, 63 aa, synthetic construct
KLKFFRKLWKKMPKKSRPKKCKQKLISMLCNAVMALLLQATAIAWDRKRARESIFMCDKAAKR

SEQ ID NO: 8003 - protein, 34 aa, synthetic construct
FFKLMQRLIRFWRRHAKFKSDYAIRAWAVRLLLR

SEQ ID NO: 8004 - protein, 51 aa, synthetic construct
YYRMIKRLLKRIRRPLRVKEKAARAQRSLHTAKFHLCPKHQLALFFPRAAL

SEQ ID NO: 8005 - protein, 50 aa, synthetic construct
KMRLIPRFFKLYNKRFARMSNPLEARKTPWACLLFKAAARAFHLKKRALC

SEQ ID NO: 8006 - protein, 87 aa, synthetic construct
RFRLFCRMWRRFTKVPGSAEDTAKLLAKSKYEPKYLLLVTIQARLMDKDKKALLKNRGRMLWKLWNREKAMKGRLAQDYKKALLRFR

SEQ ID NO: 8007 - protein, 48 aa, synthetic construct
YLKYLRRFFKFLKNSKAHFRMLLAAYMLRGLMRAHWTKRLKFRGRIWK

SEQ ID NO: 8008 - protein, 57 aa, synthetic construct
WFRFLKKLLRRFCQAKRAMALAMLCKKYVAAMLKWSELADVRRLLAKKKARMKHLRQ

SEQ ID NO: 8009 - protein, 61 aa, synthetic construct
MWRILKRLFRLLRQLDAFQLRLRENKAQLASRRSRMAAREKRRPRPLCGKKCNPGRGLRKY

SEQ ID NO: 8010 - protein, 80 aa, synthetic construct
YLRFFKRLLKMWQRRWARKRLTLHAKCRPLQRKHAVRKDQLVLAAMDLAKWLKLFLISKKLQGCAKGRRRLSVMLAQKWI

SEQ ID NO: 8011 - protein, 85 aa, synthetic construct
IMKLWKKYLRYFPCSAQKILVLMLWWAPELNLKMLKKRQRRWRNGLTVPQHQKNKARQKKLLIALAPAAAAKDLLIAARADIRAE

SEQ ID NO: 8012 - protein, 55 aa, synthetic construct
RLKWLTKIIKYLKRMKALKPDLVINHRAVRLYLLLAAPIFRLAHANWRKDKAIAH

SEQ ID NO: 8013 - protein, 28 aa, synthetic construct
KMRFLKKLLKLYRHAAKFNLSMHVEKRL

SEQ ID NO: 8014 - protein, 35 aa, synthetic construct
KLRILHKMLRKLRRVLFAPCVAARCSRRNKLAISK

SEQ ID NO: 8015 - protein, 81 aa, synthetic construct
RIRMLKKLIKMLKPMDRCAHDDKLKAALMHRALRRKYLKMVKKMRANGWVHIKRIRRKLALQDMLHMYIFKMALHLKAPLK

SEQ ID NO: 8016 - protein, 33 aa, synthetic construct
KFKFFQRLIRKLTNFRAIFLLKQWTAAAKKLRL

SEQ ID NO: 8017 - protein, 72 aa, synthetic construct
LLRLMKKILKKYKKKIARALRHRSEDRPKMLMANLPRQYQILLHDNLRIFRSKSMMPRARFKLWLALLWCFK

SEQ ID NO: 8018 - protein, 47 aa, synthetic construct
KLRLMRRWLKKFKNKLMAQRKLKLHMWITPAFELWIKTKSAHNKAAL

SEQ ID NO: 8019 - protein, 42 aa, synthetic construct
KIRLLQRLLRLWHKSKLQAKFMRKCNRKEALANGEANHERAA

SEQ ID NO: 8020 - protein, 29 aa, synthetic construct
IYKYFKRFIKLLKCLRKAASEFLTRRFLQ

SEQ ID NO: 8021 - protein, 67 aa, synthetic construct
LFRYFKRLYRIYPTRQSLRWHRRIASTKRKLAITARLWLLRRDKARARTGKRLGSLLHASMAAADGL

SEQ ID NO: 8022 - protein, 65 aa, synthetic construct
RIRMMKKMFRKFRRKKALKMAAMWLWVAARMSAAPRDLKDLKAFFRRLWKCFTARSTLFHWLALR

SEQ ID NO: 8023 - protein, 75 aa, synthetic construct
ILRFYKRLMKRFRRNADVPKRLLKVQQVGGNAKLRVATAKREFKAIADLALSLRKRYKKDQRDDKSLRIARALLK

SEQ ID NO: 8024 - protein, 29 aa, synthetic construct
RLKLYHRFFKLIKPCVTLKDYMKRAYRLA

SEQ ID NO: 8025 - protein, 45 aa, synthetic construct
WLRMLPKYIKRWRRGAYLKKAPKRNNATKRDLLRDDYKLALRATS

SEQ ID NO: 8026 - protein, 31 aa, synthetic construct
MYKMLRRLLRKLQRKIEKRRMLVLAQGTKLH

SEQ ID NO: 8027 - protein, 69 aa, synthetic construct
KIKMLRKLFKRYHCAQSRACVKKKLKRAKKQKLKKNRYFELRAAAMWMLQRRLDYLVARAQWAQEAAEL

SEQ ID NO: 8028 - protein, 26 aa, synthetic construct
YLRLLNKFLKKFSHRVQEPKLRDLLA

SEQ ID NO: 8029 - protein, 43 aa, synthetic construct
KFRLMKRWMKRICRDFLDFKKKRNYHWLLLLLRLYEKELLCSA

SEQ ID NO: 8030 - protein, 32 aa, synthetic construct
LMRMFCRWLRKLRRKLEDRIALVRMAWELPHL

SEQ ID NO: 8031 - protein, 53 aa, synthetic construct
IIRFWSKLLKFLKPAKTMRKRKQTVVRFLAAKLRRWRTPIKAAKCALAWYLVV

SEQ ID NO: 8032 - protein, 40 aa, synthetic construct
LLKIWSKILRKMRRKSALPQERYYWNPKALASRRRKLAYW

SEQ ID NO: 8033 - protein, 56 aa, synthetic construct
RYKLFTKLMRKICTHAQLTALAFVLWRRNRKDSVYAKRYLRFVLKGSAKRLAKFMR

SEQ ID NO: 8034 - protein, 29 aa, synthetic construct
RYKFIKRFLRRFTKHIVELRCLKAFALAL

SEQ ID NO: 8035 - protein, 39 aa, synthetic construct
ILRLFRRYFRLIRSAYQASQREPRLSNLARSLRAAKARK

SEQ ID NO: 8036 - protein, 40 aa, synthetic construct
YWRLLKKYFRFYKSAILYILLECLLLAEKIDQARRHNARR

SEQ ID NO: 8037 - protein, 35 aa, synthetic construct
KWKFFHKILRLLKKRRREYLCHKARALVSKQLLRL

SEQ ID NO: 8038 - protein, 47 aa, synthetic construct
KWKLLHKFLKKYSRLCWPRLAQLLDFTWKAIEKADACAIARLQRQLQ

SEQ ID NO: 8039 - protein, 75 aa, synthetic construct
RIRYYRRLIKKIKKPRWLKVARKQLITAGLRLTAHKPALKLKKNRFLRDCRQLMPKLAHKNLWNQFHRARKLCSM

SEQ ID NO: 8040 - protein, 83 aa, synthetic construct
FIKLLQRWLKFFKRQCKADETKLMKREVRRSAICRAHRRKFDKRWSLLLVRTIAARLRESALAFELEGRQPEAAAGRLVLRYL

SEQ ID NO: 8041 - protein, 21 aa, synthetic construct
FFKILKRLYRFLNKAGHWKLK

SEQ ID NO: 8042 - protein, 30 aa, synthetic construct
LFKLFPRLYRKMRKQGARARRYLLYATQAQ

SEQ ID NO: 8043 - protein, 31 aa, synthetic construct
ILKYLCRFLKLWRRRGLHLAVKSNCARRIAR

SEQ ID NO: 8044 - protein, 34 aa, synthetic construct
RMKFIKKYFKWLTRKAAAELASCWALIEWLKVLA

SEQ ID NO: 8045 - protein, 38 aa, synthetic construct
FWRLWKRLLRFFKKRLANKSIAKKHLAQHLAKNKELSK

SEQ ID NO: 8046 - protein, 28 aa, synthetic construct
KLKLLSRIFRRWRKNRRQLLAAFYMLDS

SEQ ID NO: 8047 - protein, 34 aa, synthetic construct
FFRILNKYFRRFTHAIRADRLALWMLARRKLAME

SEQ ID NO: 8048 - protein, 48 aa, synthetic construct
KLRFYTKLWKKFKRLKLILKRVDLGQIKHTAANKLKALSAKKNKILPT

SEQ ID NO: 8049 - protein, 32 aa, synthetic construct
RYRYFRKLMRIYRNRLGLYSALCLTRKLALDC

SEQ ID NO: 8050 - protein, 45 aa, synthetic construct
IMKLYCRFLKRLKKARAPNKDGIKADMRRLKLMAWRNNAYATGYL

SEQ ID NO: 8051 - protein, 57 aa, synthetic construct
RLRMFRKIYKYMRKCLAKKRALKMNQFGGHRAAAQVGLDAKQTKQLLKLCAFALLPT

SEQ ID NO: 8052 - protein, 49 aa, synthetic construct
RLKLWRKLLRRFRCRMYAAMVKGWRLASFKQLHTCAANLRDCKGRCKVL

SEQ ID NO: 8053 - protein, 53 aa, synthetic construct
ILRLYRKFLRRWPSKRQILHLADSRRNKHYKKLAIALTLACLCWHAASLRAQP

SEQ ID NO: 8054 - protein, 37 aa, synthetic construct
RLRLMKRYLRRLPNKSRRQSGPRSLGAKKWLSEDWAL

SEQ ID NO: 8055 - protein, 52 aa, synthetic construct
KLRFLRRIFRRLKQNARKGGRILKFQDALSLRLKNVCTMILVRGAVHLLRGR

SEQ ID NO: 8056 - protein, 43 aa, synthetic construct
RMKLYKKFFRKLKPRACLYRFLCYNFEPALLVKRKLVTTLKAN

SEQ ID NO: 8057 - protein, 23 aa, synthetic construct
IFKLLHKILRLFRKALDYRKRLS

SEQ ID NO: 8058 - protein, 30 aa, synthetic construct
KLKWLQKLIKRFKRAQVSVLVKLKCKWLAA

SEQ ID NO: 8059 - protein, 34 aa, synthetic construct
LFRWFNRFWRKLRTASIYKRKEAPAKAAALLCWC

SEQ ID NO: 8060 - protein, 31 aa, synthetic construct
LMKLIKRLFKILKKCILLWERRIAWRIRARE

SEQ ID NO: 8061 - protein, 70 aa, synthetic construct
FLKMMHKLWRRFKRLKCDKDAKSLDLLKAKRSQNSRARKNLKGLLKIKLKGALDACAQDSWDPASRAYMK

SEQ ID NO: 8062 - protein, 30 aa, synthetic construct
LLRLWSRLMKRWKRDRKIVLACRRWAATRC

SEQ ID NO: 8063 - protein, 49 aa, synthetic construct
RMKFYRKLLKKLKNIFRSKAKNADKHKPNQAKLLRLCVAFQYAYKPEDA

SEQ ID NO: 8064 - protein, 32 aa, synthetic construct
LLKWLTRFFKKLRKMDIKKALDWAAWCAIYCK

SEQ ID NO: 8065 - protein, 29 aa, synthetic construct
RIKFITKIYKIFTKKLRLHSAQLRAALLR

SEQ ID NO: 8066 - protein, 38 aa, synthetic construct
LYKLLKRFFRMLKKDLLIRKSILREAAYKLKKLKAAAA

SEQ ID NO: 8067 - protein, 29 aa, synthetic construct
LLKLYRRMFRFYKRLATAAAQEANPTHKE

SEQ ID NO: 8068 - protein, 43 aa, synthetic construct
RWRFIKRFFRRYKPAQNLEQCLSMKLTKLLVIRKLSARLCAAK

SEQ ID NO: 8069 - protein, 26 aa, synthetic construct
RLRLLHRLLRRFKSCARKLDALISAR

SEQ ID NO: 8070 - protein, 25 aa, synthetic construct
FLKLMKKMIKKFRCDWFASLKKALI

SEQ ID NO: 8071 - protein, 31 aa, synthetic construct
KFKMFRKYFKKFPTLYRAKTGAPALCALKRA

SEQ ID NO: 8072 - protein, 45 aa, synthetic construct
RLRLWRKLLRWLKRRAAPHEAMKKLRYYRLRILWWMKCKENLAAY

SEQ ID NO: 8073 - protein, 37 aa, synthetic construct
RMRFMSKFLKKMTRRVRRADLFKLGVWLAQRALKAEL

SEQ ID NO: 8074 - protein, 94 aa, synthetic construct
RLKLLQRLFRMLSKYFLFLWWKPLAFLLLAAPKLHKAPAPAVMHRGARRRQLRKCNWAMDLLLAWSNFDSRCKRAHVVIKWLREAVAYDNRKRK

SEQ ID NO: 8075 - protein, 61 aa, synthetic construct
LWKIYHRFFRLLTSAHAVAKCIRKCAAGVLYTAKKLKLLLNKLMWLLKLKLKRGAAKVNPK

SEQ ID NO: 8076 - protein, 40 aa, synthetic construct
KLKLYSKYWRWLKNARRDEKKRTWMKFAELLLRGLDKAMK

SEQ ID NO: 8077 - protein, 65 aa, synthetic construct
WYRFWHRWMRRFRRLYFWFHLKHSKATWKLQKKKLKLGPPDLCRSSAKLYLMRLLRARQLNKLRR

SEQ ID NO: 8078 - protein, 45 aa, synthetic construct
MLKLIKKWLKKLRCKHPVRYACMSALRCWYEYLDLVARCAKKDAL

SEQ ID NO: 8079 - protein, 22 aa, synthetic construct
LLRFLRKIYRRWKNARLRSWAG

SEQ ID NO: 8080 - protein, 23 aa, synthetic construct
KFKLLCKLLRYLRKGHSQVRLKY

SEQ ID NO: 8081 - protein, 33 aa, synthetic construct
LMRLLKKFLKRINKQRYRAANAASAIQLIMANT

SEQ ID NO: 8082 - protein, 26 aa, synthetic construct
RFKILKRLLKLYKHNSLNAPMSDAKR

SEQ ID NO: 8083 - protein, 36 aa, synthetic construct
LFRLMRKLFKLLPSRRKPAAAKNKFALEMKVIQQRA

SEQ ID NO: 8084 - protein, 21 aa, synthetic construct
KLRLMRRFYKKYPQAVAERLL

SEQ ID NO: 8085 - protein, 79 aa, synthetic construct
FYKFFKRLMRYINKFQCKEKCTWLLAQALRMARFRTLRRNKRMLKLALAKAWEKQKMIRKSKTALKTANLALERFLNFV

SEQ ID NO: 8086 - protein, 67 aa, synthetic construct
LFKYIHRLMRKLSKARLSWNIYLELKGMWATALRATLPRTARNKQLDLARRRAAGRKAFQLHIAHAF

SEQ ID NO: 8087 - protein, 21 aa, synthetic construct
MFRLLQRFLRKLRCLCERKVP

SEQ ID NO: 8088 - protein, 25 aa, synthetic construct
KFRLLRRLFKMIKRTKQQSRAAAIA

SEQ ID NO: 8089 - protein, 20 aa, synthetic construct
RLKFWKRLFKKFHKYSLAML

SEQ ID NO: 8090 - protein, 49 aa, synthetic construct
LLRIFKKLLKLMNRSKKLLLFRYRWLPLLRLPARRPNLFPTRELAKSSA

SEQ ID NO: 8091 - protein, 30 aa, synthetic construct
FLKFFCRMLRIFRRVRAAKRCELAKARAFK

SEQ ID NO: 8092 - protein, 52 aa, synthetic construct
LFRFLKRLWRRLHQRRGELFMSSKLSRFLMMRKVRDAKKRATLKVHAVAKAP

SEQ ID NO: 8093 - protein, 20 aa, synthetic construct
RFKIITKLLKFLRKHVPAGA

SEQ ID NO: 8094 - protein, 46 aa, synthetic construct
WMRLMRKMLRRICHNLVALLHPHKHKAYAAIHHADRCIRRKLRKLL

SEQ ID NO: 8095 - protein, 21 aa, synthetic construct
FMKYYKRMLKILRHRKATLIA

SEQ ID NO: 8096 - protein, 47 aa, synthetic construct
RLRLLQKLFKMWSKPINLAQAIRRPMVAEKKAWVAKKRVLYMGLRKR

SEQ ID NO: 8097 - protein, 26 aa, synthetic construct
RFRFWQRLYKKLRRCLDVLNKKAAAN

SEQ ID NO: 8098 - protein, 41 aa, synthetic construct
RWRYFKRIMRILKRIPAKKKMKKNDILLADAAAYDLEWRAM

SEQ ID NO: 8099 - protein, 77 aa, synthetic construct
KIRIFKRILRKWRSFLRLGRPFLMLRLARATRAALAVKFWRNAMMLNAMMKLLCVEEAWRRKASLTRAKEMLHKKWL

SEQ ID NO: 8100 - protein, 45 aa, synthetic construct
WLRFLPRLLRIFCKKDGRAPALAFRKYAHRHTLNAALPKKLGMLC

SEQ ID NO: 8101 - protein, 49 aa, synthetic construct
LLRLINKLLKRLRRMANALKSNYRFRDAPRGKAPKRGALRFWMVSALTL

SEQ ID NO: 8102 - protein, 91 aa, synthetic construct
KMRFYRRYLKKLTRLFKLPSYCVLIKCKMFLCNKWAPCNWVLFAPLKLKARRKYDFRRARQSYLKIRMRPAHNHRDLARAQLKAQLRLLLA

SEQ ID NO: 8103 - protein, 34 aa, synthetic construct
RLKLFQKMMRWIKRKMWNARAELNYEARQLLRIA

SEQ ID NO: 8104 - protein, 77 aa, synthetic construct
KWKLYQRIWKLLRCPKALKRANLRKKYKKCSKKLRGNKAVAVDRLTARMFNRPTALLFKLWFQLLIKKFVGPLKKAA

SEQ ID NO: 8105 - protein, 21 aa, synthetic construct
KLRFLCKLLKRWRRYLEWNNE

SEQ ID NO: 8106 - protein, 26 aa, synthetic construct
FLKLWQKMYKRLRKALLELKMYNALM

SEQ ID NO: 8107 - protein, 79 aa, synthetic construct
KIRMLKKMYRKFKKKAVAMLKKAYHLKKAHAFNQARSLDLAAEIYKLVRARCFLYEVINRKKMPERTWNRPLKLLNTAK

SEQ ID NO: 8108 - protein, 29 aa, synthetic construct
KLRLLHKFLKRLRKKTKFNLDWNTHLASS

SEQ ID NO: 8109 - protein, 33 aa, synthetic construct
LFRFFQKWLRFLRKAAKCGFARDFLKLKRARLL

SEQ ID NO: 8110 - protein, 22 aa, synthetic construct
KFRLLKKLLKRFTCRNQTHLLK

SEQ ID NO: 8111 - protein, 46 aa, synthetic construct
KFRWFRRLYRKLTPLKRLVRANLAATFLRLIALIAKSIALMKYRRE

SEQ ID NO: 8112 - protein, 71 aa, synthetic construct
RLKLFKRLMRRIRPTGLCKKKLASMRCKRWLRQKCAMKWGWKVHLTKARALKSEPAANAMEIRMKKQIAAK

SEQ ID NO: 8113 - protein, 94 aa, synthetic construct
RLKFWRKLLRKLTHLRKLAKVRCRSAAYRYRCLYAGIYPTARAIMAKAKGRKAKHCLQEKLQGALNRLMAGTAKTYWARLDMITAPRQLKWYLQ

SEQ ID NO: 8114 - protein, 67 aa, synthetic construct
YLKLLKKLLKLINKKQAGRYYRCGFKNRKNCKRAWKMDFIRKDEMKPKRFDANKLLHYATRKALAAV

SEQ ID NO: 8115 - protein, 20 aa, synthetic construct
YLKILCRLFKYWHTELALRR

SEQ ID NO: 8116 - protein, 67 aa, synthetic construct
RFRFWRKWLRKLQPYCVYLDAHDALKDKTLMKKARRVLRPVPQRKGAKRLQLYTLLRNRLKRLLIER

SEQ ID NO: 8117 - protein, 22 aa, synthetic construct
LYRLYCKILKKLNHKLRAARLP

SEQ ID NO: 8118 - protein, 76 aa, synthetic construct
LFKFMRRLYKMYHKRTARRKLRLKLLFRMEEFAAAIGLDKLNKEKLLRIARRLKNWAKLKKSPFIRFVILWNHLLK

SEQ ID NO: 8119 - protein, 20 aa, synthetic construct
RMRMYKRLMRLFKSLAKAWY

SEQ ID NO: 8120 - protein, 24 aa, synthetic construct
RLRLFSKYIKKLRKHLEPLLFKFL

SEQ ID NO: 8121 - protein, 76 aa, synthetic construct
RYRWISKMMKLFCKWKKACHAMKWRYIKNCFLAARRLKVRRGKFAGVEAKDRAANVLHACRAKSAARSALMLCLRL

SEQ ID NO: 8122 - protein, 59 aa, synthetic construct
IMKMFRKWLRRFKKLSGRCKRPDFRLLARAATNKDKMPAAMAELKRRTLFFAARQAFRE

SEQ ID NO: 8123 - protein, 47 aa, synthetic construct
LYRLIHKIYRKINRKMLNLPKRKFSKLSMAASQGLLLRIFRFKKKSA

SEQ ID NO: 8124 - protein, 54 aa, synthetic construct
RLRYLKKFLKKMKRLERHAMTKWSKACIVFKLAAEADACHRLVAVYMRSKRQKE

SEQ ID NO: 8125 - protein, 48 aa, synthetic construct
KYKLMQKLFKRLNRLQQAAKKKLAASIIRQLECARAKAKKHHRKCWKL

SEQ ID NO: 8126 - protein, 57 aa, synthetic construct
RYRLIKKMYRKWRSEVKDNYCRRLLKRKLITCWLKRLASSAERRKYSLAIALPASGA

SEQ ID NO: 8127 - protein, 40 aa, synthetic construct
KWRMWKKLFKRMRQRREYFAKADLVMDARRPLIYLSAGKL

SEQ ID NO: 8128 - protein, 52 aa, synthetic construct
RLRIFKRWWKRYRTAKHLAPCADRCSARKRAEPRKVCLLKCAAVIAQGRLWW

SEQ ID NO: 8129 - protein, 83 aa, synthetic construct
IYRLMKKMMKKLKRLKCVRFTAAAQKYLANVDWFAKMNLAADPKKSCTRERLCRAKLYAKTASCVRKFKKFLLRHKMRSYKWA

SEQ ID NO: 8130 - protein, 45 aa, synthetic construct
KLRLLKKLLRKLRRCLGLCLCAFGDPAVGRWRQITPECLLNRAID

SEQ ID NO: 8131 - protein, 55 aa, synthetic construct
YFRFFRKFMKRMRKAHKMAQAAERRKYKACRGGAARAWNHCLKATTFRWLLRQLK

SEQ ID NO: 8132 - protein, 46 aa, synthetic construct
RIRFLRRFWRRWPKRLMPGSKALRAMLELTTKKAAARKNLLQWNPA

SEQ ID NO: 8133 - protein, 31 aa, synthetic construct
KLRMMKKLLKRLKNAHKSNYKYLAAWWLKKW

SEQ ID NO: 8134 - protein, 72 aa, synthetic construct
LWRFLKKMFRLFRRSARKYHIRRIMRYKHQAYKPRPAATMLRSRKAIAQVLEATNAGKKSRRAKAARLELNL

SEQ ID NO: 8135 - protein, 21 aa, synthetic construct
RFRWLRKWLRRLPNRQGLTNL

SEQ ID NO: 8136 - protein, 60 aa, synthetic construct
RLRLFKRWFKRINRAMHACAKRRLLPKTFQYAKTHAKLISDAEPQLPLWYARYRALKQWL

SEQ ID NO: 8137 - protein, 60 aa, synthetic construct
RYRIFHRMFRKLTKYFWKELGDLLFRAKLEAECALKLLFAIARSLLLHNICLLRSMRLHK

SEQ ID NO: 8138 - protein, 34 aa, synthetic construct
KLRFFKRLYKRLKKKFWDLMPLLARQAAGKKYAK

SEQ ID NO: 8139 - protein, 30 aa, synthetic construct
KLRWLQKIIRLLKQMAGPQLNTLLRWMRLK

SEQ ID NO: 8140 - protein, 22 aa, synthetic construct
MYKLLHRLFKMWQRLLCFKKAA

SEQ ID NO: 8141 - protein, 93 aa, synthetic construct
WIRMIKRLLKLLKPLRRAEAQRAERSHEALKFRWGARILKKRALPNDVDAAFIWRKRELTRGLYLKKELAGRALNRSVDANVAALCERALMLH

SEQ ID NO: 8142 - protein, 32 aa, synthetic construct
IIKLLCKWLKKIRKGTKTVLLKTKRTMLRQAA

SEQ ID NO: 8143 - protein, 43 aa, synthetic construct
FLKIWKRLFKRMKQKFLICAFIEKSFLAAMLRCIKAKRRLVAK

SEQ ID NO: 8144 - protein, 66 aa, synthetic construct
WLRLLKKLLKKLRQHKAFKRISRKLECRALGFRCINKRAYRLAGNSWPLCLKPLVQHRHACVCVKK

SEQ ID NO: 8145 - protein, 63 aa, synthetic construct
KYKFLRKIFKRMKQFLPGALDLKIDKLRAAQVMVKLTRVLIKLLVGQKYARQKNLLLTKSEAK

SEQ ID NO: 8146 - protein, 92 aa, synthetic construct
KWKMWKKLYRKLHPGKPAKKGADFLGRAKLWAEALKFRYALMLDYTLSLINSLMRAENRKKQKCRKPASAPMADRARAKRYFKGNLMNSLRA

SEQ ID NO: 8147 - protein, 54 aa, synthetic construct
KLKLFKKFLRLFRRRCAAKAKYRHTIALAGIKGKPRTTRRYFQAQRAGAYGLFN

SEQ ID NO: 8148 - protein, 46 aa, synthetic construct
WLKIIKRMFRMLKKRKEARLILIWRKWLGFTAMKAADRALHAIIIL

SEQ ID NO: 8149 - protein, 30 aa, synthetic construct
LMRLLRKLFKKLPKLRMAQCLLRPFTLPAN

SEQ ID NO: 8150 - protein, 30 aa, synthetic construct
LFRFLRKIIRWLRNRRLKGEAFLRVATQKE

SEQ ID NO: 8151 - protein, 25 aa, synthetic construct
WWKLLKRLMRIMCKAGCPLTYKKLR

SEQ ID NO: 8152 - protein, 59 aa, synthetic construct
LFRLIRKWIRIIKKKRLQMGHALDRDSAAFGLIRLSMHARLRRGASILTVAKRCAKRKA

SEQ ID NO: 8153 - protein, 62 aa, synthetic construct
RWRFLKRLWKKWRKCKFKQTLSCFRLIDLASLVLYGKYARAAARLFLQKQALKMKHLAINIH

SEQ ID NO: 8154 - protein, 52 aa, synthetic construct
LIRMLTKLLRKLTKLPNGRPPLRRTPVVRRRLKNCAWAMRLLDAPHRNDLLK

SEQ ID NO: 8155 - protein, 98 aa, synthetic construct
RWRLFRKMLKKLKCGPGADRKEKFDSSRAGKCLEFQMKQLWRAQWCHGAKLRALRKMRKALAAFNMDRLLKRMLRAKTIGVAKKREKAMACIGRIYNL

SEQ ID NO: 8156 - protein, 52 aa, synthetic construct
KFKFLRKMIKMFCHVLTREQMKKRARARAVLARLVQMMRDAFFLHLKNRALR

SEQ ID NO: 8157 - protein, 32 aa, synthetic construct
RIRYLRRFLKMLKRKALKFEAILQFTWRLNSI

SEQ ID NO: 8158 - protein, 33 aa, synthetic construct
KLKLLNKLLKRLSPADPKWLRSKACYGRPQLLW

SEQ ID NO: 8159 - protein, 25 aa, synthetic construct
KFKIYKRLFRKFNKLLLAWIRDLCV

SEQ ID NO: 8160 - protein, 29 aa, synthetic construct
LLKMYRKILRRLNRASLPLSVLMMPERLI

SEQ ID NO: 8161 - protein, 34 aa, synthetic construct
KLKFFPRWMRKWQNAILRAEMRYKAAKAAKRTSH

SEQ ID NO: 8162 - protein, 26 aa, synthetic construct
YWKLLKKWLRIFKKIACTDLAALCRN

SEQ ID NO: 8163 - protein, 22 aa, synthetic construct
LMKLFRRLYKLLNRTQIKCAVL

SEQ ID NO: 8164 - protein, 72 aa, synthetic construct
KWRLYPKLWRILKPKFCLLAHNAMSATMLALLRAKNGKQILPQKAQKRCYAVKCLPWFRAANKRAKKPKWLG

SEQ ID NO: 8165 - protein, 51 aa, synthetic construct
LWRFYKKYFKLLQRELKYAAAKARLRMQINTDFHAEKRKQREAPRRKTSAL

SEQ ID NO: 8166 - protein, 29 aa, synthetic construct
LLRYLPKLLKRFRREVKKNRLPYCYYMWA

SEQ ID NO: 8167 - protein, 55 aa, synthetic construct
KFRYLRRLLKKFRHLMARLRLKTWTVRTLAGAPAAHWLVKREWNAKKNLGGKQLR

SEQ ID NO: 8168 - protein, 21 aa, synthetic construct
LLRMLQKMWRRFRRKLLQNAA

SEQ ID NO: 8169 - protein, 24 aa, synthetic construct
KLKLWPRFIRRLKRAWLFLKHGGG

SEQ ID NO: 8170 - protein, 34 aa, synthetic construct
LWRFIPRLLRYIKRLFRKALRRAMFQLQHVLHWL

SEQ ID NO: 8171 - protein, 28 aa, synthetic construct
RMKLYPRLWKFWSRLAKLDTLRKLLRWR

SEQ ID NO: 8172 - protein, 29 aa, synthetic construct
RLKLIKKLWKKLHTKKTKQLNWARCAWLV

SEQ ID NO: 8173 - protein, 20 aa, synthetic construct
KWRLLCRIYKMWQKRLFALV

SEQ ID NO: 8174 - protein, 33 aa, synthetic construct
LLRFMKKILKLFTKKLNPGGRKYGLRAHNKLSK

SEQ ID NO: 8175 - protein, 43 aa, synthetic construct
RFRYFKKLLKKFKKPCLKRGKLQENKEALSGVKKRYVLLLVAL

SEQ ID NO: 8176 - protein, 100 aa, synthetic construct
KMRLLHRLLKYLRCKCAMAATWPADPKKLDSKYFYLSEALGRALKAGKALQVLGAKQRKKVRVLWFLVKWLKERAIMTMDALPDSWAGRRAVLKINAEAA

SEQ ID NO: 8177 - protein, 51 aa, synthetic construct
KMKLLTKYLKRLTKLKARAADIVKIALFQLFQPKQAKYLMKAKQAQYAITA

SEQ ID NO: 8178 - protein, 54 aa, synthetic construct
FMKILKRFFRLMPRKELLRHHACCHRQNRLAERLAYALALHALSRIRCHDLKLC

SEQ ID NO: 8179 - protein, 67 aa, synthetic construct
LMRMLRKILKRFRTRLVARTATRDYLYFLKHACKRARPKTGQLDRLLKAQVLKIFRVMGMDRKQAIK

SEQ ID NO: 8180 - protein, 87 aa, synthetic construct
LYRLFCRFLRKFRRVVRAEKINAYACVKRLKILAQLPFVARRWLLNRKCKAHLRKFARSSLRKENEGEKLRALLHGCGRDQRKMLAL

SEQ ID NO: 8181 - protein, 43 aa, synthetic construct
KFKLLSRYLKLYCNEAKKQHEALYDRLGHAWVLKERRLKWNLK

SEQ ID NO: 8182 - protein, 63 aa, synthetic construct
RIKYMRRWLRRMRKEIYACAELRLKDPLATLRNLNLALAGDHLKLQEFAYVCKAADLKMCKKQ

SEQ ID NO: 8183 - protein, 94 aa, synthetic construct
KLKFLSRLLKRLTHRTLRAKNNKAIWDLINFYSIALLECREAIKMWKRFAMCRKACGLARKKAFTSKPLCAWKWRTKGLKIARLKCQDKAAAIS

SEQ ID NO: 8184 - protein, 59 aa, synthetic construct
RLKFIKRLLRRLQRATYLLFKVCAGHYRWARAITRLRLLGWHWRLRWRRLTLIAKLFIH

SEQ ID NO: 8185 - protein, 49 aa, synthetic construct
KMKIYKRLYKKMHKPMSFWGANRSDVHKAKGLLKAAARCRACKRDALSL

SEQ ID NO: 8186 - protein, 27 aa, synthetic construct
KIRFLTKLFKLLKPRLKKLKKANWLTA

SEQ ID NO: 8187 - protein, 67 aa, synthetic construct
KFKILKRIFRRLKSEFNDLKATALDADYCVFRDACLRAKKTWFANMSRDNWKCKLGLRRALLRKKNA

SEQ ID NO: 8188 - protein, 40 aa, synthetic construct
KFKFMKRFLKRIKRRHPDLPSGQDFDLLRRLATAARAADQ

SEQ ID NO: 8189 - protein, 91 aa, synthetic construct
RLRLFKKYWRLMHKANLAKKQQNHLREPLMKGRRYKWKRKDRRNAAKGTRHLDHLKQAHHLRCAMTPKYALGLKMMDDRRKLRLACQAEYA

SEQ ID NO: 8190 - protein, 98 aa, synthetic construct
KLKLLRRLIRMLRPRIGKHTLKRLMMKNPTRMATLLCLDPRMLEDNNLQRARLALSNTLCRFSSKAKRLFLKDSKKFAKRGAWVKKLLDKWLLRRTAT

SEQ ID NO: 8191 - protein, 46 aa, synthetic construct
LMRILCRLLRMLCKRKCRQVSTIFLNMRRLYLLLLQLARMELFKCK

SEQ ID NO: 8192 - protein, 60 aa, synthetic construct
KMKFLSKYLRLMHRANACILRSKLSMAQLPWQLRRRHLLNLKADARRSWHEIRKHALNRM

SEQ ID NO: 8193 - protein, 72 aa, synthetic construct
YFKFMKRIWRFFRRKKLRDARLAKVEANRNFPLARRGRAVKCKLYRPAWRLAAAARIVKTLNAVELHVTLKR

SEQ ID NO: 8194 - protein, 64 aa, synthetic construct
ILRLLQRYLRKWQRPLHATALEGSRTWDKRWRKRHAAHLSLRLHKDRFAKLRAAIRGCAAFLKA

SEQ ID NO: 8195 - protein, 38 aa, synthetic construct
ILRFMRRLFKLIQKAAKKQAIWSKGRVWRVAYAKAKIM

SEQ ID NO: 8196 - protein, 55 aa, synthetic construct
RLKLFRKYLKKFKRKLNADLTSSLIRLAVRHKHNKLKYPVACQYRLCLPALYSAM

SEQ ID NO: 8197 - protein, 49 aa, synthetic construct
KFRWFQRMFKRLKRLKLIRRKGRKKLATMISQRPEWRLAEFAALLAAKV

SEQ ID NO: 8198 - protein, 34 aa, synthetic construct
YLRLIRRFLKYFCKRKLDVAWANWAAVQQAARGK

SEQ ID NO: 8199 - protein, 20 aa, synthetic construct
ILRYYNKLIKLFNKIALKAG

SEQ ID NO: 8200 - protein, 72 aa, synthetic construct
KLKYLRRILKKLCRRFWRDRFWATCRHKELLKAVNMCAHLCMKLLRYLRRRCLMNAWQALAIRFYCRNKHAQ

SEQ ID NO: 8201 - protein, 23 aa, synthetic construct
FLRLWTKFFKRLQKAYALLCCKD

SEQ ID NO: 8202 - protein, 32 aa, synthetic construct
KLRILRKLLKKLSPRKCWADMQQANAMRRLHK

SEQ ID NO: 8203 - protein, 23 aa, synthetic construct
KMRLYHRLWRFLHHNRDAKQLLR

SEQ ID NO: 8204 - protein, 52 aa, synthetic construct
WYKIYKKLWRIYRRLNSRRSACLRFMNLALKKKAAQKRLWRAKYKVRNLSLQ

SEQ ID NO: 8205 - protein, 79 aa, synthetic construct
KLKLYRRMIRWFRKFSDKKVQRCVAWLAKALPIAKMARALVAFKVLVKWILRILFLDRGARNCKHEYERRLASRKCIAA

SEQ ID NO: 8206 - protein, 86 aa, synthetic construct
KYRFFKRIWKLYKKARNAKPLHRRDHCFALLANQLPAILGLAKQSRYLLGRKSWRKCCKSKYEALREVNILAPDKRKARADKASVK

SEQ ID NO: 8207 - protein, 31 aa, synthetic construct
IMKFLNRFLKFWKKNKTPYARARALARLFRT

SEQ ID NO: 8208 - protein, 37 aa, synthetic construct
KLKLYQRIYRLLHSNANMVRDKFLRRKLLQASMKRMR

SEQ ID NO: 8209 - protein, 20 aa, synthetic construct
KLKMLCKYLKLWKRASCLKA

SEQ ID NO: 8210 - protein, 32 aa, synthetic construct
RLRYLRKLLKKLTRFRDNLKFGIRKLCTYINL

SEQ ID NO: 8211 - protein, 56 aa, synthetic construct
FLKLFRKYFKYFPRCLDKMQHVNLWLLLKLTAAEFLWFKRTRLKQRMLPAKRRGRA

SEQ ID NO: 8212 - protein, 49 aa, synthetic construct
KFRLLKRFWRFLKHAGLVRLIGRLTLLTKARAPLLDSEAKRWKRRVWAI

SEQ ID NO: 8213 - protein, 96 aa, synthetic construct
LLRLLQRFLKIFKSLKAAVESAALVPARVIYRPQAHRKLCKVDLKLKIWYRATIRACKYAKAKKRQERYAFTGMAAWKGHTQRLLRKELKVRMNRR

SEQ ID NO: 8214 - protein, 59 aa, synthetic construct
RFRLMRKFWRWWKNTKSMWRPIQLRLVFAARLGKRQMLRYRAADPALAAKMRAVQTLRL

SEQ ID NO: 8215 - protein, 46 aa, synthetic construct
RIRWIRRLYRKFKRLKARLWGEKRFWCALKKLYALATTECLRLKLQ

SEQ ID NO: 8216 - protein, 72 aa, synthetic construct
LIRLYPKFMRLFPNGWIRHGARECKYLGKRAWRQIADLAEKCMAKAKKNARLRLRNKLWAKAMAKKKSIYML

SEQ ID NO: 8217 - protein, 27 aa, synthetic construct
RIRWLKKYYRLIKPGFLALDARDPLKM

SEQ ID NO: 8218 - protein, 25 aa, synthetic construct
WMRMLRKLLKFMKCSMRAARFAKLT

SEQ ID NO: 8219 - protein, 39 aa, synthetic construct
RLRILNKLFKRYRQWKCLLAALLKQSKKLGRHKTMWCCH

SEQ ID NO: 8220 - protein, 21 aa, synthetic construct
RLRFFKKLLKRFKPKLLLDAR

SEQ ID NO: 8221 - protein, 21 aa, synthetic construct
WLKMLRRLFKLFHRDCTSRKA

SEQ ID NO: 8222 - protein, 37 aa, synthetic construct
KLKLWRKLYKIYRRLMWDRLGLFFCTFAGARKMRALA

SEQ ID NO: 8223 - protein, 43 aa, synthetic construct
KLKFMRRWFRILQKKGKEQLKKRINCRMKGMPVLAPAALKLAL

SEQ ID NO: 8224 - protein, 29 aa, synthetic construct
RLRLLKRWYKLLRKAALTHWRWPQTCGDA

SEQ ID NO: 8225 - protein, 31 aa, synthetic construct
RIRLLRRIFKLWRKYKLRVLSHYCLIKYALS

SEQ ID NO: 8226 - protein, 50 aa, synthetic construct
MLKLWKRMLRKIKKLRRAARCYAAKIQLLWVQLAMASYLGRKYCKWRRAL

SEQ ID NO: 8227 - protein, 48 aa, synthetic construct
KIRMFNKFLKKWNNALLRDRLMLIKLSYRALATLHRRKEARKLAKSKK

SEQ ID NO: 8228 - protein, 89 aa, synthetic construct
MLRLLRRLMKLFKTHAKKLLLKALHKHSKATAKIDARLIRAKKLIVRRRPTELKCRQKEVRNSHLCRRKTACCLKAKANNSCQLPMDAQ

SEQ ID NO: 8229 - protein, 36 aa, synthetic construct
WMKLYKKYFKYLSTCALLIKKYALWQVRARELLRKL

SEQ ID NO: 8230 - protein, 69 aa, synthetic construct
RLKFLKRLFKKFPKRGIQKWRRAQAAAAGVKLSDKCRHLARQHKLRAVDEELEKTKLRADRRIAIQIII

SEQ ID NO: 8231 - protein, 58 aa, synthetic construct
KMKLWRRFLRKYRTRTKNAARTWRYGCRMKKPELPLLKKQTVYALMHALVYPKWARLA

SEQ ID NO: 8232 - protein, 64 aa, synthetic construct
LLKYLNRLLKKWQRNNKMLRKHARGKATRREALRPHKEVVLMNGACRAAGADKRPWYVKRQALE

SEQ ID NO: 8233 - protein, 23 aa, synthetic construct
RLKLIKKLWKRIKPARLKCTALV

SEQ ID NO: 8234 - protein, 23 aa, synthetic construct
KLRIFCKLLRMMRRDWRQATALR

SEQ ID NO: 8235 - protein, 31 aa, synthetic construct
RLRIWKRIFKKLKRAKFKLACMKCKLLLAAN

SEQ ID NO: 8236 - protein, 28 aa, synthetic construct
LLRMFRKLLRRYTKQYARLFINRIRDLD

SEQ ID NO: 8237 - protein, 23 aa, synthetic construct
RYKLLKKMFRRYCKWKAFQGLLA

SEQ ID NO: 8238 - protein, 36 aa, synthetic construct
RLKIWRRLLKIIKKKKKGYACVFIILAAQLKALDWS

SEQ ID NO: 8239 - protein, 47 aa, synthetic construct
RMKWLTRFLKRFNRALICYERLAIRLALDRRAIDVLIQAMKKRCRWD

SEQ ID NO: 8240 - protein, 40 aa, synthetic construct
LWKFFRKFFRLMKKDLQRKLLRATAAQADLYLLAFKRNRK

SEQ ID NO: 8241 - protein, 43 aa, synthetic construct
KWRLFRKFFKKWHRAHKRKLSLRDCKLLYNQDAWHRLRNLVAF

SEQ ID NO: 8242 - protein, 41 aa, synthetic construct
RLKMLSRMFKRLRHAGRCRKAARAACQAYAKFIVWHWHKAI

SEQ ID NO: 8243 - protein, 50 aa, synthetic construct
KWRLFKRIWRWFKKLAKKRTKAESLLANHAVKLLKLLKGRLQLCYLLVKK

SEQ ID NO: 8244 - protein, 58 aa, synthetic construct
LIKMIRKLWRWFRKGRDRSALKAYKHKVLWAVAPKRLADDELLLNRNNFAKHKKQFFL

SEQ ID NO: 8245 - protein, 20 aa, synthetic construct
LLRLYCKLFKKFRTIKTQAI

SEQ ID NO: 8246 - protein, 20 aa, synthetic construct
YLRLLHRLFKYMRRRQLDNM

SEQ ID NO: 8247 - protein, 57 aa, synthetic construct
RFKMFKKFYRKFKRKKLRRYWYPAARFKKPKAPFLALPALRWIDLKTKAPHAISALY

SEQ ID NO: 8248 - protein, 38 aa, synthetic construct
KMRMMRRLFRRLCRRKNVAALRIKNALLWLPRGMRECL

SEQ ID NO: 8249 - protein, 67 aa, synthetic construct
RIRIYKRLIKRLCKHGQRRAAWKPLGYKAARNIKALCARTQRGIKLKFTRMKGAALLCVLLKELYKS

SEQ ID NO: 8250 - protein, 56 aa, synthetic construct
KWKMWHRWLKYLKKLRSERHARQKFHLSDKKTALGHLATTACRWGNATAKRRAKRV

SEQ ID NO: 8251 - protein, 30 aa, synthetic construct
FLRLLPKIMKKIQKKLRLFNKGAMLRALHF

SEQ ID NO: 8252 - protein, 24 aa, synthetic construct
KYKLYQRLMRKFKRVYPARIACAA

SEQ ID NO: 8253 - protein, 32 aa, synthetic construct
RLKMLRKLLKKFCSLNHKTGAALPASAQPKMR

SEQ ID NO: 8254 - protein, 37 aa, synthetic construct
YIKFMSKWLKLMPKKALLLVSARYHARLFRIRDKKAP

SEQ ID NO: 8255 - protein, 29 aa, synthetic construct
MLRLLKKMFRKYKQMEALEWKCLARYLAA

SEQ ID NO: 8256 - protein, 22 aa, synthetic construct
RIRLFNKLIKKLRKGGRALLNG

SEQ ID NO: 8257 - protein, 31 aa, synthetic construct
WIRLLKKYYKKFNSGVRAEKRLASKLLAAYF

SEQ ID NO: 8258 - protein, 25 aa, synthetic construct
WLKMLKKLFKFIKRKGAEPLQAAAR

SEQ ID NO: 8259 - protein, 35 aa, synthetic construct
WLKLFKRYLRKMQTRKAPHSLRRAARLAILASAHK

SEQ ID NO: 8260 - protein, 67 aa, synthetic construct
FWKLMCRFFRRWRSYGVKCLSKKSATERRRAKCVHRARALLNTRVPQRAWHELLAALNKRKYRLRFA

SEQ ID NO: 8261 - protein, 34 aa, synthetic construct
RLKLYRKWLRWFCRCGPMKLNKELGLKAALKSPN

SEQ ID NO: 8262 - protein, 90 aa, synthetic construct
WMRMYKKLIKWFQNQQVHKLRQLPVTRRRLKTAIRLQELVAPKAARKELARCHFFFKRLPAARKYRKTLKVWALKAARRERKANWMVTAR

SEQ ID NO: 8263 - protein, 55 aa, synthetic construct
YLKLIRKMYKKLRHWRFKFPLDFKRMHRRYIAKLIKLRKALIYAAWDRQCAPAQA

SEQ ID NO: 8264 - protein, 28 aa, synthetic construct
MLRWLKRFFKRLKQAGTDKRIKLLALAR

SEQ ID NO: 8265 - protein, 81 aa, synthetic construct
YLKFFNRLFRRITKMTAFRAKNLKFEFLRAHSKMLSDMRSAKKTRRKRRAARRAWGKPALNARWPLARNKYKTFLYVKLLD

SEQ ID NO: 8266 - protein, 38 aa, synthetic construct
YLRIYRRIFKRMPTWTCAVGAFGLAKKAKLKPAKKAKY

SEQ ID NO: 8267 - protein, 48 aa, synthetic construct
YYRFMQRLLRKYKQLLRKKLCKGAHKAQAFKFKVVCTAAYKWAAAMPL

SEQ ID NO: 8268 - protein, 41 aa, synthetic construct
RLKMLNKLFKRFKCLQKMHRRRIAEPSLAIVNRLNLLALTH

SEQ ID NO: 8269 - protein, 25 aa, synthetic construct
ILKILPKLMKILSKCRAHLAATTRE

SEQ ID NO: 8270 - protein, 24 aa, synthetic construct
FYRFLRKLLRLLQSPKLMKSRRCA

SEQ ID NO: 8271 - protein, 28 aa, synthetic construct
KFRLWRKLFRIWQKRLGERLLLPAQQPR

SEQ ID NO: 8272 - protein, 41 aa, synthetic construct
KFKWLRRWLRFLKSKDYKHFILKKCERSTLKAWAKALARAL

SEQ ID NO: 8273 - protein, 24 aa, synthetic construct
RLKLLKKWLRLFHQACLRVKQEPM

SEQ ID NO: 8274 - protein, 57 aa, synthetic construct
KLKWMQKLIKKLRTKVLWRFKFAWRYAKRSLAMLKDYCPFALKRKKLRLILTICNWF

SEQ ID NO: 8275 - protein, 87 aa, synthetic construct
KLRLWTKLLRLLKRHALLHMPVLLRDRNWKGKALAWHIGHHELLFFRLQNHRHRRKIFRRDCKLAAQRGPHKREIFKRFLSHALKKV

SEQ ID NO: 8276 - protein, 21 aa, synthetic construct
LLKYWRRLWRRMHKKMLYAAV

SEQ ID NO: 8277 - protein, 61 aa, synthetic construct
ILRMMKRFLRFMKKYTPLYGNNRAAKARPCTKHETELRLHLHALKRACKNLLWRKKKRYVK

SEQ ID NO: 8278 - protein, 49 aa, synthetic construct
KMRFYKKMWKRMKNMLNAQKLFRLWCACMAVALLLNRRMAAGLARDITA

SEQ ID NO: 8279 - protein, 27 aa, synthetic construct
RYKLFKKWFRFWHRQEAWAEKAKQAAL

SEQ ID NO: 8280 - protein, 75 aa, synthetic construct
MYKLMKKYFRRFRHDFIARLVFKKLSLHSMKAARLRANARRALKVRERAILTDGMFEKRIFAWAKATTRKRAYKR

SEQ ID NO: 8281 - protein, 41 aa, synthetic construct
YIRWYKRFYKRFRRGNLERRRHRAAFCIEQLAKRLLYEALL

SEQ ID NO: 8282 - protein, 79 aa, synthetic construct
RMKLLCKYWRKLKQLARQAMTEKLKHERRALVAKAVKLKVSRGIRCVALARCEQKSAAWRCRQKDVHSRRELAALWFNR

SEQ ID NO: 8283 - protein, 29 aa, synthetic construct
LWRYYPKFFRIWPKDLMAKVLDARKRLRA

SEQ ID NO: 8284 - protein, 92 aa, synthetic construct
KIRWLRRYFKFLTKLRGAQRLWKAAHMQKLKQWKRTAHFNQAEASKKCLALKFLFWRLRLLSLTLFARKRKSLKDAKWYELVWTALAMRHNW

SEQ ID NO: 8285 - protein, 32 aa, synthetic construct
LFRMFTKLLRRLRRLTRRMMKQLYLKEEHQPA

SEQ ID NO: 8286 - protein, 67 aa, synthetic construct
RFKLMSRMLRKIRKDPPRLKAAADRLQADDVGKKLLQLYDFRLASKRKAKADRNKLITYYRLLAKRK

SEQ ID NO: 8287 - protein, 25 aa, synthetic construct
LYRIFRRWMRRFPKAKFLLLSIRDA

SEQ ID NO: 8288 - protein, 31 aa, synthetic construct
LMKLFKKFLKRYCRAHAHLEAIAKLTARILK

SEQ ID NO: 8289 - protein, 98 aa, synthetic construct
FLKIWKKYFRYLHTLKAKETTLSAALSALIAPMLFRMAAKFFVRYLCKYRAKLAKRPPARYPKLRQSKKCLSLIYLFLRKRDCNLNKDRLIKLLVYIK

SEQ ID NO: 8290 - protein, 81 aa, synthetic construct
MIRFITKIFRRLRKLLSLLKKLDLMLRPPRLVAWLMAIQKIRRALYADRMTALIKLLLLAYCRLEYWKCAAQHDKRYLRLM

SEQ ID NO: 8291 - protein, 21 aa, synthetic construct
KLRYLRKFLRKFHRLSEAARA

SEQ ID NO: 8292 - protein, 50 aa, synthetic construct
MLKLYPRILRLFRKLPKVNRERAGLKFAKRKHRGVWLTAYLWQSMARKAY

SEQ ID NO: 8293 - protein, 75 aa, synthetic construct
KFRYWHRFFRRICSRAGGLLLDARGARHGLQAKERAHRCRKEKLIQLQQKLLDLVLAGEKRRRPAAIGKAALCEK

SEQ ID NO: 8294 - protein, 43 aa, synthetic construct
RLKLWNKLLRRFKRCTTNAPLIRTIRKLASAAIRKWCWKYALP

SEQ ID NO: 8295 - protein, 88 aa, synthetic construct
KMRMFTRLFKRLRKAKRNLPLRAARRWLAMKLKRPHRDLAVWRARYKAGAQKSVPCPFADKVRKCMREALDTWRARKAMKRILAHKYL

SEQ ID NO: 8296 - protein, 56 aa, synthetic construct
KFRWLKKFLRKFRSAMQARDKDAAARWNRINLKKKNHWLAILSLRMWAPLFGAVKR

SEQ ID NO: 8297 - protein, 49 aa, synthetic construct
RLKWLCRYWKRIQTKAKWKRLCHPQFARRDTDAIRLAAKMRLKYWARLL

SEQ ID NO: 8298 - protein, 41 aa, synthetic construct
LYRLYKKFWKLFKKALAKLLMQANLKAYRKKLYPFLGSQSM

SEQ ID NO: 8299 - protein, 21 aa, synthetic construct
KFKLFKKYLRLLKKHHVKLAF

SEQ ID NO: 8300 - protein, 31 aa, synthetic construct
KIKLMKRLLRLFRRAAQYRFDRHVLKLKMYA

SEQ ID NO: 8301 - protein, 27 aa, synthetic construct
RLKLWQKLMKKFKQTTFLDRMHKAAFA

SEQ ID NO: 8302 - protein, 39 aa, synthetic construct
KLKLYRKMYKLLHKKEEKAIYKAARAKAAPINRCGWFKL

SEQ ID NO: 8303 - protein, 31 aa, synthetic construct
RMRLLRRILKWMKKWKANMPDLGLAAKLDDN

SEQ ID NO: 8304 - protein, 40 aa, synthetic construct
LIRLFKKLLRFIRKAKRGKVADAREAAICKLELEAQGFNL

SEQ ID NO: 8305 - protein, 66 aa, synthetic construct
KFRFFKKLFKWWRTDRRNRKGAVRSLRLRALHRRTDKALLLKAAYFWLARDDEYAQCKPGLKAAVK

SEQ ID NO: 8306 - protein, 83 aa, synthetic construct
FLRMLKKWMRRYSQRLSKAQAAPLLALRRKDLKPLGPKDLFAQVHHLKNWGRGRGKEHKKKKWRTTQVLRALQELRACKNAKH

SEQ ID NO: 8307 - protein, 53 aa, synthetic construct
RFKIMTKLLRRLRQKLLKLAFRYSQEKIEALGSLLLVKRKDKKYQNPRNNFLR

SEQ ID NO: 8308 - protein, 20 aa, synthetic construct
RLRMLQRILRRLTRLTLCYW

SEQ ID NO: 8309 - protein, 57 aa, synthetic construct
RMKLFKKYLRKWKSPAARTIQKDADLKMRLLRTEKKCASLANVHYKAKKLEPKYGLR

SEQ ID NO: 8310 - protein, 28 aa, synthetic construct
KLKLLSRIIKKFKRDLGQSRITEAAACK

SEQ ID NO: 8311 - protein, 28 aa, synthetic construct
KFRIYRRIYKMMNRARPYLLWFAAKLLR

SEQ ID NO: 8312 - protein, 94 aa, synthetic construct
KLKLMKRYIRKIKRHLCDAACAARLWKSLAKSFWLRWRKKLYVPARIKAMACFVLFKLDKATPCKATKKDFGHKRAQARRCIRAFRQKRLCINT

SEQ ID NO: 8313 - protein, 26 aa, synthetic construct
KFRLFRKIFKKLNHPEMGLKALKLRL

SEQ ID NO: 8314 - protein, 99 aa, synthetic construct
MFRILKRLYRRFRKKKWVAFRTAAKRKRFIQLKRSTWRGDLYRWHWAWHIRRTVQKARAKPAMHARPQEARNAGRKIHVLADRFRHLRLAAKLCNRPAA

SEQ ID NO: 8315 - protein, 41 aa, synthetic construct
KFRFLRKMLKRLCKRVSAMTAFVRLALKRNAEAFPLIASVM

SEQ ID NO: 8316 - protein, 27 aa, synthetic construct
KFKLLRRFWRLLQTLAPIHDEKLYKRW

SEQ ID NO: 8317 - protein, 51 aa, synthetic construct
KIRFLKKYFRRLKKARHAHFLRKLNKVLKEIEAYLCADWIADLKGLNPRRD

SEQ ID NO: 8318 - protein, 75 aa, synthetic construct
RLRMWTRYLRMIRKWHALATLKSCDKRKTKPLARQREIRYEKLGLLLWQKLLLKARHLAKPKRVYYMQGKRAARK

SEQ ID NO: 8319 - protein, 57 aa, synthetic construct
FLRYIRKIIKMLKRAARLLCHRYKRRKLALEARRLACRRVALRLAWAQDLLEQFKVA

SEQ ID NO: 8320 - protein, 27 aa, synthetic construct
KFKFLKKLLKMFPHRGDLQMGRLLLIK

SEQ ID NO: 8321 - protein, 23 aa, synthetic construct
RWKYFRKYFKRLPNEWLLPAALK

SEQ ID NO: 8322 - protein, 37 aa, synthetic construct
LLKLWRKMIRRMKPRIRISGANSQPSDLQKKLARLAA

SEQ ID NO: 8323 - protein, 76 aa, synthetic construct
LMRYFHRWMKLYKCKLNWAYYDLADKFRLNGAKKKKELKCKFQGLKLTLRLDAAKLKAHLCRLSIFRRLLELHLLF

SEQ ID NO: 8324 - protein, 41 aa, synthetic construct
MLRLMCRFFRKLNTKAAAKLQPRLRRKVLMYDLKKTRWLDE

SEQ ID NO: 8325 - protein, 37 aa, synthetic construct
RFKWLRKWFRKICRRKAARALLLKAKALHLYTLHVCC

SEQ ID NO: 8326 - protein, 38 aa, synthetic construct
WLRMLHKLLKRLRRIWMNLRSWVLRRGEAKGACLFMRC

SEQ ID NO: 8327 - protein, 41 aa, synthetic construct
KYRLFNKFFRKITKRLDLKDYAYPAAKALRAKANNKVFIKR

SEQ ID NO: 8328 - protein, 23 aa, synthetic construct
WLKWLRRFIRKLSHAIIIAAARK

SEQ ID NO: 8329 - protein, 30 aa, synthetic construct
KLKLWTKLIRYFRRWTIWLALRTAYARDFA

SEQ ID NO: 8330 - protein, 27 aa, synthetic construct
FLRFYKKWWKWIRKLAHLLQLRLGAAK

SEQ ID NO: 8331 - protein, 67 aa, synthetic construct
RFKFLRRLLKWLRNFLKLDKCKFRTKRRLRRLKVKDIEARFAKENLLSLDPSMHWAQVRKLFAHYNN

SEQ ID NO: 8332 - protein, 30 aa, synthetic construct
KLRLLRKMLKFIKSWLDARYVRGLAKYIWP

SEQ ID NO: 8333 - protein, 42 aa, synthetic construct
FLRLWCKFLRRFTREIALRLHKQKRLIGKAGYRKLRAVLYRV

SEQ ID NO: 8334 - protein, 37 aa, synthetic construct
FLKLLKRFLRFLKRGRRMFAAAKWLKATREAYWAALN

SEQ ID NO: 8335 - protein, 30 aa, synthetic construct
RMRLYRRMLRKLKRAFAAAMRRNLRSIQDN

SEQ ID NO: 8336 - protein, 21 aa, synthetic construct
MLKWLQRLIRKWNKLGHLKAQ

SEQ ID NO: 8337 - protein, 21 aa, synthetic construct
LLRFIKRWYKRMQSLAAKEGA

SEQ ID NO: 8338 - protein, 69 aa, synthetic construct
RFKFLKKFYKRMCTKLLKCMKLANALKTPKRNAAIWELRAVLRFLKFLAKLFRILATWLLWDRRLGLNC

SEQ ID NO: 8339 - protein, 36 aa, synthetic construct
RFKFIPRIWKRLKQSAADRRRCCKLAARALARHYGM

SEQ ID NO: 8340 - protein, 60 aa, synthetic construct
KLRLWRKFLRRIRRYMTLAEAKCTDLRTFRAEYRLLLSDWKLPNKLKMLKLCYWKMKQRA

SEQ ID NO: 8341 - protein, 32 aa, synthetic construct
LLRFMKKLIKKWPRRASALHILHKLLKLKRNP

SEQ ID NO: 8342 - protein, 43 aa, synthetic construct
KFKFFTRYLRRLPKAITEAPYLRYALIQQGLLKLARHKCARHL

SEQ ID NO: 8343 - protein, 20 aa, synthetic construct
LLRFMKRFLRILRHLKNPTW

SEQ ID NO: 8344 - protein, 57 aa, synthetic construct
KMRLLCKFWKFLTRLLLRLRRRLVLTNEKDGLVKQAFAYAWKPSKLAAKMYVLKTLR

SEQ ID NO: 8345 - protein, 52 aa, synthetic construct
KLRIFKRFFKYFKKARKAYHKARTNILRYDLVLRALRTNRNGLANLKLLFQM

SEQ ID NO: 8346 - protein, 45 aa, synthetic construct
MLKLYNRFYKKWKRKTQCKLLLKREISRNLTMARARKFYKAEAEL

SEQ ID NO: 8347 - protein, 72 aa, synthetic construct
RYKYMRRMMKFIKRWRRMLRIANWLARRLSVRAPMIPACKAAALTVITARKQAVTLKLRRKKSKVRARIEAH

SEQ ID NO: 8348 - protein, 39 aa, synthetic construct
KLKYFKKFLRKLSQLKSILCQRLLRWLALKVALWCNGGS

SEQ ID NO: 8349 - protein, 82 aa, synthetic construct
KLRFFKRFWRRIKCLKFGIKAFTTKLKWGKHWPKLHDQKAAKTLTKRRRFLTGGALALRKLVGPLLKLGARKKALFSGRADQ

SEQ ID NO: 8350 - protein, 39 aa, synthetic construct
RLRLFRRFMRILRPAEFKHALFRKCARWNKLGRERAAMN

SEQ ID NO: 8351 - protein, 45 aa, synthetic construct
LYRLWHKLMKRFPRLARKCLLLADKWAKEDAWLSMFRLEATATIK

SEQ ID NO: 8352 - protein, 55 aa, synthetic construct
YMRLIRKFLRILKKCKAVLMAKNWKLKKRLNLTPTICRKYLKAMFSFPALALILN

SEQ ID NO: 8353 - protein, 85 aa, synthetic construct
LLRLFRKWMRKLRRHLARALYPERRKRSKHSSLDASMKHLNLRWNSQKVKWRDRWKWSAKLRIIDATNSAASLKLCKRDRAEKEL

SEQ ID NO: 8354 - protein, 54 aa, synthetic construct
KLKFLRKYIKLLSTPMRKPLPKKANVRLLGQRLVRSAKCKYAILKQAAFIFLQH

SEQ ID NO: 8355 - protein, 45 aa, synthetic construct
RLRFLPKFFKKFCCLIPAAIASRRAFWKKKWLRKHPLLALAMHQH

SEQ ID NO: 8356 - protein, 24 aa, synthetic construct
KLKLITRLFKKYKQLVLLTAKDRC

SEQ ID NO: 8357 - protein, 38 aa, synthetic construct
FLKMLHKLLKKLKKADQCTAAPTRWSKNLIRIRGAIAH

SEQ ID NO: 8358 - protein, 49 aa, synthetic construct
MFKYLKKYFRLLTCRLKLQRDAKLRHNRCARFVMAKRAAVAAMIRRAKA

SEQ ID NO: 8359 - protein, 23 aa, synthetic construct
RYRYYHKILKRLQRMLMQLLKAF

SEQ ID NO: 8360 - protein, 24 aa, synthetic construct
RLRFFKRMYRKLKRFDAHANNAAN

SEQ ID NO: 8361 - protein, 34 aa, synthetic construct
LIKFLHKYIRKMRKLMWRCFKKCAQAALCLRAAI

SEQ ID NO: 8362 - protein, 25 aa, synthetic construct
RWKMFPRYLRLLQSLALRRYCKKRA

SEQ ID NO: 8363 - protein, 38 aa, synthetic construct
FFRYLKKLFRWYKKRAKRETLALNLFYLSKNFRLLKEW

SEQ ID NO: 8364 - protein, 88 aa, synthetic construct
KLKLLRKMFRLLKRPSRRVLCPPSDRRAKTAPSHLAAMQAQRWDGLVVTPGRKAYMAKNARKALNLALAHKKLARKTVIFSVALPLLT

SEQ ID NO: 8365 - protein, 36 aa, synthetic construct
RFRFWKKFFRLYKTLNLRRACAKADALRNHKAWLFK

SEQ ID NO: 8366 - protein, 70 aa, synthetic construct
KFKLISKWFRLLKQAKLAKQRFQELKEPAKKQKTPVYRKKKFFVKWRMTKMGRLYFKVAEPLAALKARAC

SEQ ID NO: 8367 - protein, 30 aa, synthetic construct
FLRFYKRLWKLFKCTLGKARRLKNGHRLLL

SEQ ID NO: 8368 - protein, 90 aa, synthetic construct
MYRIFRKMLKWYTCLAAIHPADCEAELMPPELAKSIAKRQALDKAKWRAHAYALARAKDAKKHGKGALCRLLANFKTRLLQRAKELMKWR

SEQ ID NO: 8369 - protein, 84 aa, synthetic construct
KIKMYRKLIKRLTKKPNDRMILEQWALFKSRKEKIGQLALPKKRRQLMAFRKKKRIYLFSQYLKKAKKRAAMMLAMLAALLDVL

SEQ ID NO: 8370 - protein, 39 aa, synthetic construct
KLRIWTRLIRRLRNLYRAAQYQKAKAFANYKWKLKAPYD

SEQ ID NO: 8371 - protein, 36 aa, synthetic construct
WLRMLPKFLKRLHKGAKALKAEKRLICRNKKAMIAK

SEQ ID NO: 8372 - protein, 87 aa, synthetic construct
RFKWLNKLFRKFSRPKRSGFFVKKLAKRVKDALEARHFLTRRYVSSIRNKLMGRRLQVTAQRRAGFRRRATAAKRQDPKSVAWLLLA

SEQ ID NO: 8373 - protein, 34 aa, synthetic construct
WLKMLNKWLRKYKKDCPAHAQHLSKCKRLLDKKH

SEQ ID NO: 8374 - protein, 33 aa, synthetic construct
MFKYLNRFLKLLRKRRRHAAAFQGRILKLMWKP

SEQ ID NO: 8375 - protein, 64 aa, synthetic construct
RWKWFRKFLRLMKKTKGWRLAKYARTAKARAAKRRALAQGKAVLMCPHRHYFEQTLLRQFLKTH

SEQ ID NO: 8376 - protein, 34 aa, synthetic construct
KLKFYKKWLRFFKRRLWEANKSIQLKLRCRAAWL

SEQ ID NO: 8377 - protein, 100 aa, synthetic construct
KLRIFQRLMRFLKKMNMAPRRRAKTAGYPAGRAHKLALAHKRKAKGRCLLFELTVSRIVLYLRLRLLGFTESANATIYKSDRAKRCMLAFTLRAIEKTAA

SEQ ID NO: 8378 - protein, 33 aa, synthetic construct
RMKLLKRLLRFWKRGRPQCLCALHLDVAYGRRR

SEQ ID NO: 8379 - protein, 83 aa, synthetic construct
RWRFYTKLFRKLTCNKLFRIYAMMVWAALKNAIRVGEPKAAVLLQTSRLAGALQNKDAKIVKPFKKAKAIRKKKIRRACRYLR

SEQ ID NO: 8380 - protein, 63 aa, synthetic construct
ILRLFKKLWRWLKRFKMEHRRMEACLYGFKQRRKKLESGARALNLRLGAPAAKKDADNEASRA

SEQ ID NO: 8381 - protein, 24 aa, synthetic construct
KLRFFRRFWKKLSRLLTIYAAQAR

SEQ ID NO: 8382 - protein, 21 aa, synthetic construct
YMKLLNRWMKKIKKLHLYHRA

SEQ ID NO: 8383 - protein, 42 aa, synthetic construct
LWRWFQRLLRLLCKVRLMMANARKLKRLNHNKIMALLHKCKP

SEQ ID NO: 8384 - protein, 47 aa, synthetic construct
KLKLLNRWLKRLRTMRLTWYAFAIRRKLRAEATICGRDAFKKREREA

SEQ ID NO: 8385 - protein, 25 aa, synthetic construct
RWRMLRKLLKRLCNDAFLLQACFKF

SEQ ID NO: 8386 - protein, 69 aa, synthetic construct
FIRWLHKFLRYMRRRLLARLAKAKKCLYTIWRKHSPYINADYMMKRLKAWKTLQLWRMADCVYRLRRAL

SEQ ID NO: 8387 - protein, 34 aa, synthetic construct
LLRFMNRLLRLFRNTLLLDNLRSKVLKEKAVCRG

SEQ ID NO: 8388 - protein, 36 aa, synthetic construct
MMRLMPKMYRRYRRLLALAHLFKYSLRKVYLFRQYK

SEQ ID NO: 8389 - protein, 26 aa, synthetic construct
KFKLLHKLFRRYKPSLLVKALKSKDL

SEQ ID NO: 8390 - protein, 28 aa, synthetic construct
LYKMLKKLWRKLPCAGNKVEAKADLGKR

SEQ ID NO: 8391 - protein, 59 aa, synthetic construct
RLKYINRWLRWLNRGYAQLRKNDCLFRVVGKKRIARIALLCLEKQLRDLAAERLPAIYR

SEQ ID NO: 8392 - protein, 40 aa, synthetic construct
LWRYLCRLLRRYQRRAYQLHPGLRYKLAIVNRALVLATRQ

SEQ ID NO: 8393 - protein, 80 aa, synthetic construct
KLRLFKKYIKRLKKCAEGARMSRGTLFLRLRKILDDFRRQDRRPTQNRLLARPRGQMAKFLCTLHARNRPKADALTCRDM

SEQ ID NO: 8394 - protein, 27 aa, synthetic construct
RLKFYKRLLKKFTKVMGNAFAARSARH

SEQ ID NO: 8395 - protein, 77 aa, synthetic construct
KLRWWKKLLKKLNQRYLAKPNKVRVVSKLGQCWLERSQLKHLLRKRAQTKRKLYACLRFVTRTMCRSVAYYARRRAC

SEQ ID NO: 8396 - protein, 20 aa, synthetic construct
KFRLFPRYLRKMQRSLAAPL

SEQ ID NO: 8397 - protein, 30 aa, synthetic construct
RFKLLQKLLRFLQRKWRGAGTHPLRVRRGL

SEQ ID NO: 8398 - protein, 21 aa, synthetic construct
MLRLLRKMYKKMHTALAGHWL

SEQ ID NO: 8399 - protein, 41 aa, synthetic construct
YFRMLTKMMKYYHNRDAGAAKRRKMLMAKRKRLKLATREAA

SEQ ID NO: 8400 - protein, 72 aa, synthetic construct
KLRLLSRFWRKLKKNVQNAYPRTRADKGKFNAALKITRQHNCFDKAKALGEFALILLKLRQKAAKTAKLRLR

SEQ ID NO: 8401 - protein, 25 aa, synthetic construct
LLKLWKRLFRRFKTVANGLRSNRTC

SEQ ID NO: 8402 - protein, 91 aa, synthetic construct
LLKFLSKYWRKYKTMAGQKKKRPLWLGALTFKKFHKTDKNDWRLQRKKAAILWATKALAARLDAILTRANIHLRKGAHSMLAKERSRAWTR

SEQ ID NO: 8403 - protein, 60 aa, synthetic construct
RFKFWPKLMRLYKPKLKKRNMFRCRKLGFLAKLKHYILGSFPPRSLLANPHLAKKRLRIK

SEQ ID NO: 8404 - protein, 57 aa, synthetic construct
LLKFIKKWMKLFRRQNALPKKLYCCLHCHKLAQRKMGLQTKFQGLLLAALRFDKRLW

SEQ ID NO: 8405 - protein, 20 aa, synthetic construct
KLKLLSRMLKLFSRSSAGTG

SEQ ID NO: 8406 - protein, 39 aa, synthetic construct
KYKIISRYFRMINKLAKMRGLMLHRNARKARHLLASRLL

SEQ ID NO: 8407 - protein, 52 aa, synthetic construct
YFKIYKRFYRRYKRRALKAVTALYILPGDIAARPKDTLGISLLAKHRALYKL

SEQ ID NO: 8408 - protein, 78 aa, synthetic construct
KLRWIRKYLKKWTRFLAYNLPAQGSKLWAKRYKRDDAKKFRRNYNIRAYAERTRQRCRCLASKHAMYLWIALARGALR

SEQ ID NO: 8409 - protein, 24 aa, synthetic construct
RFKFYRKMLKRMSKLGLARLAINV

SEQ ID NO: 8410 - protein, 27 aa, synthetic construct
RMKFFRKLYRKWQCQLTVRLGALAKAK

SEQ ID NO: 8411 - protein, 98 aa, synthetic construct
KLKLLRKFFKRLRPETDLMCLLARAYLLSVAKFINHLALGILANQYFRLKAKDCMMRRLWLSYAAKNCKHRYRAPLRIRSRGAICESCTLALLEATKK

SEQ ID NO: 8412 - protein, 41 aa, synthetic construct
IYRWLRKYLRFLRKAKCLKRGAWLQRLARTDRPACAWMFKG

SEQ ID NO: 8413 - protein, 72 aa, synthetic construct
KLRWMRRLLRLWKRKAKEATGMKMANYRRHLRPKKRMCMRAVTQTANAIAEARWGFPPAKLLVLKKAKSVKC

SEQ ID NO: 8414 - protein, 27 aa, synthetic construct
LLKLMKKFLKRMRKAPDTTLTCKAIRG

SEQ ID NO: 8415 - protein, 58 aa, synthetic construct
RYKFLSRLLRWFKKAAANLLFKLVSMREKIALRAFIRLWARRKKFRAGGWDICAAMRA

SEQ ID NO: 8416 - protein, 36 aa, synthetic construct
MYKLLNKLLRRMRKRHPASVKCAKLWNCASHILKWK

SEQ ID NO: 8417 - protein, 38 aa, synthetic construct
ILKFYKKLLRLWQKADLLLFAYLKCTKRKRVQKTKRSE

SEQ ID NO: 8418 - protein, 41 aa, synthetic construct
YIKILNRLWKLLKKLLHSVRCHAKAMGAAARQRRLECAAWC

SEQ ID NO: 8419 - protein, 32 aa, synthetic construct
KLKLWKRYFKKMRQCLLDKCIRANRNAPTAKA

SEQ ID NO: 8420 - protein, 23 aa, synthetic construct
KWKLFRRFLKFLKSALRVILAQR

SEQ ID NO: 8421 - protein, 54 aa, synthetic construct
MLRIMSKMFKRLPRKSFWISRLLYDTKAKLLLLKELKKRRCHILRYNAARCYAK

SEQ ID NO: 8422 - protein, 59 aa, synthetic construct
RFKLLRRILRKMKQPQAKHQRMKVARKRCRERLVPFTDKLASLLRPRANCAKHLLRLQA

SEQ ID NO: 8423 - protein, 29 aa, synthetic construct
WFKFLKKFLRKLHRSARAKYTAAPRSNAR

SEQ ID NO: 8424 - protein, 21 aa, synthetic construct
RLKYWRRLFKKFKHMTLCALL

SEQ ID NO: 8425 - protein, 47 aa, synthetic construct
FIRLLSKLMKRLHCHRELAGRRFMWLRSRARRKMKLAAWELEALIAR

SEQ ID NO: 8426 - protein, 53 aa, synthetic construct
MLKLFHRFFKFFRRALLKNRLTAAVASLAARDFKDRLKVLASVKLKVCFHLEA

SEQ ID NO: 8427 - protein, 47 aa, synthetic construct
YLKLISRIFRLYKTAWADHIKLIRKKALLMLARRARTAYQTRQWSDR

SEQ ID NO: 8428 - protein, 24 aa, synthetic construct
IFKMLRKYYKRLKRLLAARQKKAA

SEQ ID NO: 8429 - protein, 43 aa, synthetic construct
RLRFIKKFIKRLKRKKSWFRRYASASADGCLAYARLPIACVSK

SEQ ID NO: 8430 - protein, 23 aa, synthetic construct
KLKLFKKLLKLYKKIRLKKLMLQ

SEQ ID NO: 8431 - protein, 27 aa, synthetic construct
RLKLFRKLFKLIPPANKQDRLDAKPKW

SEQ ID NO: 8432 - protein, 28 aa, synthetic construct
YLRILTKFLKKMRKLKRHCLEAKDYILY

SEQ ID NO: 8433 - protein, 35 aa, synthetic construct
RLKMLKKLLRLMRPDLGCHLNLRLRCLTRTWLYPV

SEQ ID NO: 8434 - protein, 24 aa, synthetic construct
LFRLMCKLMKLLRTYAQRRKLLHQ

SEQ ID NO: 8435 - protein, 56 aa, synthetic construct
RLKLLRRLWKKMSKLMLWRAKAHLGQFRMKAKSQRAWASMMARVKANVNWNRAKKL

SEQ ID NO: 8436 - protein, 48 aa, synthetic construct
YMRWLNRLLRKITRLAKPCELVRRNHLFLRKKQEVMLKRLAGHQLAKI

SEQ ID NO: 8437 - protein, 28 aa, synthetic construct
YWRLFRRFLKKLKRLLTAAKTYGAQRKT

SEQ ID NO: 8438 - protein, 46 aa, synthetic construct
LFRFLNKYYRKWPRKRLTLYAMWRLAFRYFMYKALRQKKAALNSKC

SEQ ID NO: 8439 - protein, 38 aa, synthetic construct
RYRFFKRILKILPSRFKVLNPARARLPKALRATDKLDA

SEQ ID NO: 8440 - protein, 29 aa, synthetic construct
LWRMLNRLFKRFQRLLRRIDLEKWVKIAQ

SEQ ID NO: 8441 - protein, 52 aa, synthetic construct
WMKLINKFYKRYNKSALLLRAATPWDRLTKLRKIAWRKVHLLRRHQNLRKML

SEQ ID NO: 8442 - protein, 59 aa, synthetic construct
YLRFWHKYLKMFPRDDKWRMNPALRSMKNALIARAMVLKEKWARACLKAPLLSALRKKC

SEQ ID NO: 8443 - protein, 58 aa, synthetic construct
LWRLFKRLWKRIKRHELKGGAKKRVRAAKQNSYHANDKNKWTKDWWLLQLALLCCAKK

SEQ ID NO: 8444 - protein, 47 aa, synthetic construct
RYRLFSRFLKRMRTCAVQLKKPAAPLARTAALGCARLERRVYVWAPA

SEQ ID NO: 8445 - protein, 36 aa, synthetic construct
KLRFLRKIIKRLTKDAALLGFAWAAYANWVVREHRL

SEQ ID NO: 8446 - protein, 61 aa, synthetic construct
MYKLLSKLFKYWSRSLVRMVAWQAAARMLRYKLRPDAAIRKKRAKQGKAAKHNLMLEIWRL

SEQ ID NO: 8447 - protein, 33 aa, synthetic construct
RYKLFRRMLKRLTPKCLMLELTAEPLLFLLFIK

SEQ ID NO: 8448 - protein, 66 aa, synthetic construct
RLKILCKFYRKYQRMLALKDRDKLASLQPWLKKHAKWHRALIFKQAGNRTDLKKAKNKYRLCPNIK

SEQ ID NO: 8449 - protein, 57 aa, synthetic construct
RIKLLHRMWKRLHKNARCTFHARLKEPKWAWDLRLTAYKRTARCRAILAFINADLNL

SEQ ID NO: 8450 - protein, 61 aa, synthetic construct
RLRLLRRMIKKIHHLPDSNGERLGGPAALLKKRKLPNDLVPAQHLARAWRRAHACAAKWEN

SEQ ID NO: 8451 - protein, 39 aa, synthetic construct
LFRLYRKFFRKMRPWLPRNLKKSAILANCRAALGAEGNL

SEQ ID NO: 8452 - protein, 23 aa, synthetic construct
FFRLYRKLMKLFPKQHLLPQRKL

SEQ ID NO: 8453 - protein, 29 aa, synthetic construct
WFKLWKKFLRLLPRTCQVEFLGKARLRLK

SEQ ID NO: 8454 - protein, 28 aa, synthetic construct
RMRLLRRLLRLFRKHQQSAKKRACSIAP

SEQ ID NO: 8455 - protein, 30 aa, synthetic construct
LIKLLRKLLKLWTCLKQARFTAKKKFQKRQ

SEQ ID NO: 8456 - protein, 53 aa, synthetic construct
RIRWMNKYFKRIKRYKAAKAKNRACARLMLEAWHWETFALTWKSLLAFKLYAR

SEQ ID NO: 8457 - protein, 33 aa, synthetic construct
FMKLLKKLWKKIKSAMNLLWARRIDLRKDAVLH

SEQ ID NO: 8458 - protein, 34 aa, synthetic construct
FYRFLRKMLKLLKSNRQAATIARKLWSHASAKDW

SEQ ID NO: 8459 - protein, 54 aa, synthetic construct
LYKMLKKMLRKLKKRIRLLLMTQRKYATMALMPTLAKYILTKAFYDSRKGRYFF

SEQ ID NO: 8460 - protein, 54 aa, synthetic construct
MLRYLKRLMKKYKRILADLKYLHLRIISRARLSTKKARHLHKAVLNLKLIKFRL

SEQ ID NO: 8461 - protein, 30 aa, synthetic construct
KYRMWKKWWRLLCRTAAKKAAAKPCVHPTK

SEQ ID NO: 8462 - protein, 52 aa, synthetic construct
RMKMWKRFYKKWQKAIRLKRERKLAAELWTLLAATAAVGWLKLNGILLQHTC

SEQ ID NO: 8463 - protein, 60 aa, synthetic construct
KIRFFKKMLRWLQRYCRYCLRTRDLRRQALVAKDKLWKLADFMKAQKHVAVAKLQKYPPL

SEQ ID NO: 8464 - protein, 79 aa, synthetic construct
RLRLFHRFLRKWKNAHFLLAGSLLAHGAVRLDCLAASNIMKKDCWMRQKRLRTAAQSELKRIRLCRAGLSVLYRAKELK

SEQ ID NO: 8465 - protein, 39 aa, synthetic construct
RIRLFKRWYRRFKRARPTLRNRPYALARVLAAAYACETW

SEQ ID NO: 8466 - protein, 70 aa, synthetic construct
RLRLIKRLMRRLPKFAMNYIEEKMCALYAYRWHDWRANKLKFSACKELKCLASRTCRAAVGLYRRARKAC

SEQ ID NO: 8467 - protein, 39 aa, synthetic construct
LFRFLRKMFKLLSRRVAWRRPYKCKKLAACKYYMSLNPL

SEQ ID NO: 8468 - protein, 55 aa, synthetic construct
MFRLLHKFMRKMKRTAKLDAVLKGKRSYTMHCKLCTMAPKFKRMILKALKKKALP

SEQ ID NO: 8469 - protein, 76 aa, synthetic construct
RMKLYKRMWRLYKCWERLAYADHGEYKRKAARTTACQLNRRAREFQKKRKFEKKAGPALFAIIRKLKLKTYKAELT

SEQ ID NO: 8470 - protein, 60 aa, synthetic construct
RIKYLSKFFRKFKRMMRLPSLKFDRLQRKKKLCQKAWAWRWWKTRATADTLERLALRDLD

SEQ ID NO: 8471 - protein, 29 aa, synthetic construct
RFKMLRRFYKKFRHALQDRVASHAAAAQQ

SEQ ID NO: 8472 - protein, 48 aa, synthetic construct
YLKIFKRFLRFMPKMHLAVRNRRCLAFADWSARVAKAAKRATYAYPLL

SEQ ID NO: 8473 - protein, 42 aa, synthetic construct
LLRWLKRILRKIRNAAKDRPYALPHVVKATGKVHKRKEFGAR

SEQ ID NO: 8474 - protein, 47 aa, synthetic construct
RIKLWSKYFRFWQKSLAPRLKMLKASCRLLLPKLCAVLRMRIYGALK

SEQ ID NO: 8475 - protein, 56 aa, synthetic construct
KLRLFKKFFRKFCRKHSYRRDFFDALFAASRSINILNSRALAKTKLGRQAARALES

SEQ ID NO: 8476 - protein, 58 aa, synthetic construct
RFKMMTRYLRKLRTERELRKRAAAGLATKYWDRAIRLRAHSPWVAEALTVLAYAFKHH

SEQ ID NO: 8477 - protein, 70 aa, synthetic construct
YLRFLSKIWRKLQRLPKCQSRDPAREAKAARAAKRLRRYMSLMQFEALIKAKKDFARRPLFGAAIARKRK

SEQ ID NO: 8478 - protein, 82 aa, synthetic construct
FFRFLKRLIRLFTTTALLAWWLLRPDHRNQFKRLRLHRRACRGRPGWDPDRNVMLAAARAAERATAAWCSARRLKGYKWLRR

SEQ ID NO: 8479 - protein, 23 aa, synthetic construct
MLRLLKRMFKFLSRACLAMVHER

SEQ ID NO: 8480 - protein, 29 aa, synthetic construct
RYRWLKRLFKRLKSIKKATWVQLALTKQA

SEQ ID NO: 8481 - protein, 58 aa, synthetic construct
MLKYLKKMLRRLHKKLLKFGKLEAGIMARANREPALAAQLYRNRFNMARHNQEMVRFK

SEQ ID NO: 8482 - protein, 31 aa, synthetic construct
LWKWLKKFLKKWKKEAFVRLWATAPFLAAHK

SEQ ID NO: 8483 - protein, 75 aa, synthetic construct
KMKWLSRYFKRLKRVKRTDTQKSLNARPLLPPATAKACIKKREAKDNCANRCEAKLMLLLRKLLLWAWNQPEKRV

SEQ ID NO: 8484 - protein, 79 aa, synthetic construct
YLKLIKRWIKFMRQGMLENKKYAYARANDVKLFRGLKEYAYKAEYKLKRMIKARLKKAKRLFLWQLLTQMKAKKPKKPG

SEQ ID NO: 8485 - protein, 22 aa, synthetic construct
FFRFLKKLLRRLKHIIAKEAIR

SEQ ID NO: 8486 - protein, 59 aa, synthetic construct
YYKLIRKYLRFYNRKLKLDPVKWTYHKPYALKYMRCLKKKSQLKLKAARYCILCAAPKK

SEQ ID NO: 8487 - protein, 78 aa, synthetic construct
RMKLYPRLLKKIQSFNSARDHGARPKPNIARKRALTNSKEKLYIIAKKAASDARRPLELFTRPDRAAAIWKRARAQPL

SEQ ID NO: 8488 - protein, 46 aa, synthetic construct
FLRLFRKILRRMRRGINLDRDHNHLLAAHRSLALKFAFRRNDLAGL

SEQ ID NO: 8489 - protein, 81 aa, synthetic construct
RFRLWPKLYKIISRADNLHANRLKFLGGGSKFTPRKKSARLIYAKIRPKLCKDAWLLLRAKAKRSAYRAVALRLTGDKYWD

SEQ ID NO: 8490 - protein, 61 aa, synthetic construct
KLRWLKRLYKRWKCLALATLLLAACKVDCVLIQMKRFLKLKKDEQFPWNCGDIRRDAKRAV

SEQ ID NO: 8491 - protein, 33 aa, synthetic construct
YYKLWQKLYKKFQKNLGAAKDREHKLRYLAFKL

SEQ ID NO: 8492 - protein, 58 aa, synthetic construct
FLKMLTRMIRRLQQKQRKLGAACFSTMLRACRKQKKVLAYLMELRARFAAQEMWLRSA

SEQ ID NO: 8493 - protein, 20 aa, synthetic construct
FLRWLQRLMKLLTKDHCPRK

SEQ ID NO: 8494 - protein, 55 aa, synthetic construct
YFRFLKRLFRKMKPKEVKRDRIALTWKGLEPRAMARARYAFRMQTRSLMAIRAAK

SEQ ID NO: 8495 - protein, 50 aa, synthetic construct
RFRLYQRLMKRMRCAFRKAAKLRANNLRIDARMAVIGLLDAHKVTNSARR

SEQ ID NO: 8496 - protein, 40 aa, synthetic construct
MYKIIRKLLRMFKHAGHLGVAHKLKLHLYLRAQRATSLMK

SEQ ID NO: 8497 - protein, 21 aa, synthetic construct
LFRWLKRLWRWFKKAQRASMC

SEQ ID NO: 8498 - protein, 35 aa, synthetic construct
YWKLMKRIWRLLRRKLSVDASRNKQLCFKLHKLAM

SEQ ID NO: 8499 - protein, 33 aa, synthetic construct
FLRFFSRIFRRYKKRRANDMRLAYLLALAGWHK

SEQ ID NO: 8500 - protein, 38 aa, synthetic construct
MLRLLHKFLRFYKKMYLKDYNPWRLKARAEANPRPLKL

SEQ ID NO: 8501 - protein, 36 aa, synthetic construct
RMRLWRKYLRFMPRKAMLIRALKAADRALKKTNCYW

SEQ ID NO: 8502 - protein, 87 aa, synthetic construct
LLKFMRKMFRLWKQFHYKVRAFPTFAARLEAWLAARMYHAAEKAFRRKGANAQVNRCTLEARLAGAYLAMARLLYGHAKRYPLWKQK

SEQ ID NO: 8503 - protein, 58 aa, synthetic construct
KFKFWKRLMRKLHRKRAPDWRLAKMRLWRCVACTASNALFMTAKKWVLLATCPSLLRV

SEQ ID NO: 8504 - protein, 35 aa, synthetic construct
FLRYYKKYWKKLSKAAWLNYLLWVFAARSVKKAPR

SEQ ID NO: 8505 - protein, 78 aa, synthetic construct
LLRMIKKLMRYWTHMNAKFLPAAALHKRLEGSQLLTHKVTLLGYACKKRKLLREKAGWKCRMRHALGLLRGAHARMPI

SEQ ID NO: 8506 - protein, 36 aa, synthetic construct
ILKFLHKLLKFLKKKKYAREQLVGSKLAAWWGIRPN

SEQ ID NO: 8507 - protein, 51 aa, synthetic construct
RLKLWTRYMRIIKTLYLRLLRCAVRAKETKKKKKYAPPLLKLLEIRKKFTS

SEQ ID NO: 8508 - protein, 31 aa, synthetic construct
KLKYLRRYIKRLKKPLARPKAHVHHLKLATR

SEQ ID NO: 8509 - protein, 54 aa, synthetic construct
RLKWWKRLFKLICKKAEAGDLLLLWPPKWPARMDAKQGAKADQCRRARVMKHRY

SEQ ID NO: 8510 - protein, 21 aa, synthetic construct
FFRWLKRYFRLMQKLLNKARM

SEQ ID NO: 8511 - protein, 39 aa, synthetic construct
KLRLMCKFLRFLKTRYLPYAALRRRNDKLNVRAMAKDMG

SEQ ID NO: 8512 - protein, 58 aa, synthetic construct
FFRILRKMIKKMKPAWKDKKLQYKLCHLIRRYQHLARRHSAAAAAYYAKRKYSWAHAM

SEQ ID NO: 8513 - protein, 21 aa, synthetic construct
KLKLFNRFLRFLNKWLRKLRD

SEQ ID NO: 8514 - protein, 68 aa, synthetic construct
LLKYMKKLFRYYTPLAFENLASRERRNFVLALCCSLRRLQLAKYMLKRKKWSLKLAKGCANLKPVRMQ

SEQ ID NO: 8515 - protein, 85 aa, synthetic construct
RFRFMRRLFKFWKKHRKNVRLAQNLSDLRLRLRRKRLNARLRPPKKRYAHWKLNLLARHPKWAYQRTMSPLKSPCFLADSTKAVI

SEQ ID NO: 8516 - protein, 46 aa, synthetic construct
KLRLLKKFLKFFRPADKGDKGMALVIDLSFAAMIKRALKHMLCAAR

SEQ ID NO: 8517 - protein, 23 aa, synthetic construct
KLKLWRKLLRRFHKAPDGVARFV

SEQ ID NO: 8518 - protein, 64 aa, synthetic construct
LIRLIRKFFKRWNKIGKLRKTEAKLKYRLRANMRRNCKLMKLYKWRVNALMLLTPRDAQSIQAK

SEQ ID NO: 8519 - protein, 26 aa, synthetic construct
RMRLFSRLFKRFSRELAEARLTAPAT

SEQ ID NO: 8520 - protein, 48 aa, synthetic construct
LIRMYKRLFKKFTPKHRAAVMDRQLAKQALWAKRLKKYKLLWAQFASM

SEQ ID NO: 8521 - protein, 57 aa, synthetic construct
KLRLWTRLFRKYRKAGLKKDRDCKLWACARACRKADSIWKTRLQLLKRGYILVRRLY

SEQ ID NO: 8522 - protein, 40 aa, synthetic construct
RMKFLTRIIKLLQKKGNSGKKLARYAADLLVDATKLTLFM

SEQ ID NO: 8523 - protein, 26 aa, synthetic construct
RIKLFKRFLKLIKQAARFAKQALFRA

SEQ ID NO: 8524 - protein, 20 aa, synthetic construct
WLKWLNRYLKLIKQAKWFKY

SEQ ID NO: 8525 - protein, 20 aa, synthetic construct
KIKWICRLIKRLQKALGPLQ

SEQ ID NO: 8526 - protein, 52 aa, synthetic construct
WLRFYRKLLKLIQKRIAKPKLATKVARRCLLPPFRWCKTLRFLLLLAAAAHR

SEQ ID NO: 8527 - protein, 37 aa, synthetic construct
KFRLYNKLLRKFPQITKKIPALHLARLERRKVSALRK

SEQ ID NO: 8528 - protein, 22 aa, synthetic construct
LFRIYKRWWRRLNRKYNAAARA

SEQ ID NO: 8529 - protein, 66 aa, synthetic construct
RFRFLKKLWKRMKRKLRNRCLAFEKSRATLARRKAIMRREKRAANLWSPAAAIMKQNRLDARLMRY

SEQ ID NO: 8530 - protein, 63 aa, synthetic construct
FYRYWKRLFKKYRRTYRAAEFPASRHTPHSFINAKRSRLRFLAAWAKKQLKKKNRLALIALLR

SEQ ID NO: 8531 - protein, 25 aa, synthetic construct
RMKILKRMLKRLTPLFYKDKLLLKY

SEQ ID NO: 8532 - protein, 61 aa, synthetic construct
KFKLFQRLLKRMKKAQNALRAKLARDANRKEREAKLILKKIYRYDSDKRKLRRNHCLAFCL

SEQ ID NO: 8533 - protein, 65 aa, synthetic construct
MYRLFKRLWKKIKKSKFFQNRRWAALAVAKHNRNRLRYMKLVHIMRPTANRSLAGLLRKLFWAPA

SEQ ID NO: 8534 - protein, 45 aa, synthetic construct
RFRWFRKMLRKYKKSAHLWVRKKAHLDAEMLSHAAGSAAYFLKHR

SEQ ID NO: 8535 - protein, 65 aa, synthetic construct
YLKIFTRWLKKWRKGKALLGLNALLLLRPDANRKFEPSFIACKLKKAATKCKWKPLLHVKAKRKN

SEQ ID NO: 8536 - protein, 51 aa, synthetic construct
KLRWMPKLLKILRKLAHEKHAAKFRDLIQKPRAWKWARKLLNCFRRKVHKF

SEQ ID NO: 8537 - protein, 55 aa, synthetic construct
RLKFYCRILKLFRPSRQTAGLRKGRKNHQFFLSKKRLLTRNLRKRPVQLRLPGLL

SEQ ID NO: 8538 - protein, 38 aa, synthetic construct
RLRLLTRLIRKIRKKDALCRDAKRRAMKTCAVLLAKIK

SEQ ID NO: 8539 - protein, 51 aa, synthetic construct
IFKLFKKWLRRLRHKQRSLARLKQLDVKRSHDRKARHMLNLLQRMRFLDID

SEQ ID NO: 8540 - protein, 24 aa, synthetic construct
LWKLLRRILKILKRLTKWTKFTPH

SEQ ID NO: 8541 - protein, 21 aa, synthetic construct
LIKMINKLLKKFCRWAYRRAL

SEQ ID NO: 8542 - protein, 44 aa, synthetic construct
KLKMLRRFLKRLNCLAKYKLIQANGCRREQIACWAQKKPGAKAL

SEQ ID NO: 8543 - protein, 60 aa, synthetic construct
FYRFLPKILKKMPKLHKWHMDIREAAKVLITRKLSMRVHRLALLWAKHAAAKPDLKKNAV

SEQ ID NO: 8544 - protein, 47 aa, synthetic construct
LYRYFRKYIRWFNQWDYKKAKKCGRKSKCLFKATPIRLLRALARVAL

SEQ ID NO: 8545 - protein, 40 aa, synthetic construct
RWRLLKKLYRKYKNIPGDAAEAACGMVRRLALPLALLRNK

SEQ ID NO: 8546 - protein, 21 aa, synthetic construct
FYRIFQKLLKLLKKMKYDAWK

SEQ ID NO: 8547 - protein, 80 aa, synthetic construct
FWKLFNKFFRLFRRLALWMRLARWLARVPARKKRLKPIDRCKEPPLPPAPLFYEAYRLALLLKKLLKSDVTLRLQMLFKP

SEQ ID NO: 8548 - protein, 24 aa, synthetic construct
LFRLLKKYLRMIQCRLIPRARADL

SEQ ID NO: 8549 - protein, 59 aa, synthetic construct
KLKLMKKMFRMLKRAKALRETLYQNRLVLARARAERPLLDAQLRHRLAYITGYWMPHVR

SEQ ID NO: 8550 - protein, 23 aa, synthetic construct
RFRFYQKLLRRYHKDLRARLAHQ

SEQ ID NO: 8551 - protein, 82 aa, synthetic construct
LIRYMKRLLKLLRRQEELCRTAEWAKRRRQLRLKKPALAQMQLGKLAFIEAFTEVARMYAKKLQIKLLIRLRNCTGRSRALL

SEQ ID NO: 8552 - protein, 51 aa, synthetic construct
LFRIFRKFFKFYRRLLRHSLKYLDCRDAAKALLAGWTDDRKMALARASLAN

SEQ ID NO: 8553 - protein, 27 aa, synthetic construct
KFRFLKKLLKRLRKMPFIQTAGTALIG

SEQ ID NO: 8554 - protein, 59 aa, synthetic construct
RMRMFKRIMKRFNRRAAWLGKLDKKMRPAQLPRLVRKAALLNWATKKKLIAWAPRGTFV

SEQ ID NO: 8555 - protein, 22 aa, synthetic construct
RMKLWQRILRYYSRWLILAKLA

SEQ ID NO: 8556 - protein, 26 aa, synthetic construct
RFRLLKKLLKMLHKYAAHFALKDKKE

SEQ ID NO: 8557 - protein, 22 aa, synthetic construct
RLKLMQKLLRFFHKQAARYHAC

SEQ ID NO: 8558 - protein, 47 aa, synthetic construct
LLKLLQKFLRRLRKRYARQRMSAHWLDKYKWSKAHLTDTEKITLALF

SEQ ID NO: 8559 - protein, 54 aa, synthetic construct
RFKFLNRFLKIFKRGPPANKKPKKRRAQCESSKKQLAWRLLQRQPLAKKLQLGA

SEQ ID NO: 8560 - protein, 30 aa, synthetic construct
LWKMYHRIIRRYKRKLAARFKRDALFPARL

SEQ ID NO: 8561 - protein, 41 aa, synthetic construct
FIKFFRRYLRYYKRKLRKLDFAAAAFALARCHKKAQLPSKR

SEQ ID NO: 8562 - protein, 86 aa, synthetic construct
KMRFYNRMLRKLTSKTVMMLRLKRHRAMFLVNRLMKTEKFMAWMAAKRLRLLDLERAQRKKLMEALHQLKERKHIKLGLELATTAW

SEQ ID NO: 8563 - protein, 71 aa, synthetic construct
LYKLWRKFLRLIRRQKFAWYLKLDYLFCAGAAKKKRRLMLWKYKDEASFAFMLLRVVKIALIHYLWRIRVR

SEQ ID NO: 8564 - protein, 44 aa, synthetic construct
MLRLLHRLFKKWRTKLLGYKPPKNGLATMNALKAHKAYSTRAKE

SEQ ID NO: 8565 - protein, 25 aa, synthetic construct
RYKLLPKLLRFLNKKRMKVWCAQLV

SEQ ID NO: 8566 - protein, 21 aa, synthetic construct
WLRYWRKMLRLLKRQMLQWKA

SEQ ID NO: 8567 - protein, 72 aa, synthetic construct
FMRLLPRLLKRFQRKPTALLDQDREAAFSAEKLKIKMKALEMRLLKAFLPKKLRLAQRTYPKCKMKKYVFWY

SEQ ID NO: 8568 - protein, 60 aa, synthetic construct
LFRLFQKLFRLFKSVDRLWIIKKKFMAKFRYYARAALGVGRVARCLMRAAVKNRARMLCL

SEQ ID NO: 8569 - protein, 63 aa, synthetic construct
LLKIIKKLLRLLKKKRPLYQRFPGTRNFDRLREAMNLTLIKLERSVPNCLTWRWLKALLNAAT

SEQ ID NO: 8570 - protein, 33 aa, synthetic construct
KLRYIRKLYRMFRHLKNSEEARLPRLTLLKWKC

SEQ ID NO: 8571 - protein, 35 aa, synthetic construct
LMKMLKKLLKRLRRQCIVRQLRRWFTCFCLLRVLG

SEQ ID NO: 8572 - protein, 59 aa, synthetic construct
WLRWWQRMLKRIRKLAHLWTKRKVTKRQLQAAHQRTRSKRSAFARTLQDLPAKRAWAYL

SEQ ID NO: 8573 - protein, 54 aa, synthetic construct
LFKILRKLFKKLRKQLHMWFIFAKRAVLRRYESLTNAQWKKTVRLRLNARKREQ

SEQ ID NO: 8574 - protein, 45 aa, synthetic construct
KFRLFHRLMRRFSNAGRVARLHRARAPKACDKRLVRYFAKPDRNL

SEQ ID NO: 8575 - protein, 57 aa, synthetic construct
LIRFLKKFLRFFPKHLALRIKIKTAPKRLTKTALDYIMLTRPRKLNDIQATRKADRR

SEQ ID NO: 8576 - protein, 40 aa, synthetic construct
YMKWFPKFLKRLRPVRLCLTFCLRAIDKVMEWAAKRKKAR

SEQ ID NO: 8577 - protein, 47 aa, synthetic construct
KLKWWKRIFKRYKRRASKWASLCAAAKAIARKLKDLSIISNYLCCAA

SEQ ID NO: 8578 - protein, 24 aa, synthetic construct
FMRLLKKFYKLWNTPRLLAAWLQR

SEQ ID NO: 8579 - protein, 71 aa, synthetic construct
LLKYLRRYWKLFRKRAYKCALMYKRHHKAAANTRKQLWLGRHILETLRHQKADPKMKPLSQCLRAQLPRAL

SEQ ID NO: 8580 - protein, 34 aa, synthetic construct
KYKLLRRMLKRFKNADTPRRRIAEPDKAMHLALM

SEQ ID NO: 8581 - protein, 45 aa, synthetic construct
KIRLLKRLLRKIPCHLFMKLRGKTRKHEAWNRRNAHAKWLYGAKI

SEQ ID NO: 8582 - protein, 27 aa, synthetic construct
YLRWLRRLYKLMHTLSRALRYNKWLRK

SEQ ID NO: 8583 - protein, 63 aa, synthetic construct
RLKYFRKLLRFIKRKQAPKQLAPGIQLRFNRYYLRAHFMKKDALAKATLRQDAPERELCLNCL

SEQ ID NO: 8584 - protein, 47 aa, synthetic construct
LLRWLPRLYRRWKHRREGKHLLLIVVTQLADMSKKGKEAVAMAKAAR

SEQ ID NO: 8585 - protein, 40 aa, synthetic construct
LIRLMKKWIRKFRKRKRRVAKLALLVIALLWVPCTDYVLK

SEQ ID NO: 8586 - protein, 54 aa, synthetic construct
KLRFYRRLFKFLQHRTKARNSAWCVFMLKRNRRRRNVRIARCIALLLLWRLAQL

SEQ ID NO: 8587 - protein, 31 aa, synthetic construct
KWKFLNKLFKFLKKACRCLARFYTRLARLAH

SEQ ID NO: 8588 - protein, 33 aa, synthetic construct
RMRIFQKWLKYLRRRMWNGKAKLAEKSLLLAAC

SEQ ID NO: 8589 - protein, 76 aa, synthetic construct
ILRYLRRLYRLIRPLCYATLKPARKLRKHKQLVDDSKDLPSICLYRQLFTLRAPARLPMRKEALRPRKTELALRDK

SEQ ID NO: 8590 - protein, 48 aa, synthetic construct
WLKIFKRMLRIWSKLRQRQKRAKYLAQAEKAARRRWQEIMRALNLPRL

SEQ ID NO: 8591 - protein, 83 aa, synthetic construct
FLKWLQRYFKKFRKLLYKELAAFLAKKLLWQPDRKRYALREELKKASQAFIRHKCFSRLPKDFVLKYEGKKVAMYARKVKKGF

SEQ ID NO: 8592 - protein, 44 aa, synthetic construct
FIRLWRKLLRRYPTRGASFHRDAGLYLKMKMKDMRALPLKRAFA

SEQ ID NO: 8593 - protein, 25 aa, synthetic construct
ILRFLKKWMRKWNSALVLRAKTLYK

SEQ ID NO: 8594 - protein, 33 aa, synthetic construct
LYRLLTRFLKFFRSCAVLALSKHAGRKRYFLMR

SEQ ID NO: 8595 - protein, 35 aa, synthetic construct
RWRLLRRLLRMFKRNQAERTPLNKPSKLKLKAMNH

SEQ ID NO: 8596 - protein, 48 aa, synthetic construct
RFKMYRRILKLLRRALPALLACSIFRRLWLLRKARPMIIRIHADLGQK

SEQ ID NO: 8597 - protein, 21 aa, synthetic construct
LYKWFKRLYRRMSKACCAANL

SEQ ID NO: 8598 - protein, 38 aa, synthetic construct
RFRILNRLIKLMHRASSVLRHLAVKKGMAHARAKMKHW

SEQ ID NO: 8599 - protein, 58 aa, synthetic construct
RYRLICKWFRFYRKGATARKVAYRTAALPARGGRKFQANATLLYMKTAVKKKSTAIRK

SEQ ID NO: 8600 - protein, 61 aa, synthetic construct
RFKFLRKLLRRLHKQKILMELHVRLYALLGHRMKAHVLVLYLRVPKFHQRAVDRLAARRWQ

SEQ ID NO: 8601 - protein, 31 aa, synthetic construct
MLKWMKRLWRLLPRIALFTARWSRMKRARFW

SEQ ID NO: 8602 - protein, 34 aa, synthetic construct
LLKYFKRIFRLFKKLAEAHNRLRFTVAAVRLRQP

SEQ ID NO: 8603 - protein, 65 aa, synthetic construct
MWRILRKLLKRIKRKLLASEKDLLKEDVITCVAPMLKARHLSCRAKAMHRMFALAKCGACRIPRS

SEQ ID NO: 8604 - protein, 43 aa, synthetic construct
IFRIFRKLLKFLRKHYYQAYLWRLRALMEQTLAKWRADARRRY

SEQ ID NO: 8605 - protein, 45 aa, synthetic construct
RLRMLKRIIKLYKSYNCQAYAKYRNWKLKLAKAKLGLVFKGACHR

SEQ ID NO: 8606 - protein, 53 aa, synthetic construct
MLRLWRRIMRRLKKEAKAAWDGLYAARARDRLRQRALEFLYFPQSRGVFPFRK

SEQ ID NO: 8607 - protein, 20 aa, synthetic construct
KFRLYKRLLRMWRPRLACNF

SEQ ID NO: 8608 - protein, 47 aa, synthetic construct
KLKLFRRLYKFFPKLGKNSNVSLLHCPAHKARGFAERAARKKLLQLS

SEQ ID NO: 8609 - protein, 59 aa, synthetic construct
IIKMLCRYLRRYHNLYHKDMLKEAETMLKRRSLLRRAARKCWAPAMRRQCLLRIYSRLA

SEQ ID NO: 8610 - protein, 49 aa, synthetic construct
LLRILRRFYRRLRRHLKVNLMHLLAKLKRKNLEAKCLRMNWPFLNHPLS

SEQ ID NO: 8611 - protein, 30 aa, synthetic construct
RLKLFKKFFKYLHRPWLWFLKEARMRKVLS

SEQ ID NO: 8612 - protein, 29 aa, synthetic construct
KFRIWRRLLKFYCNRLDAIKLKAKLQLLV

SEQ ID NO: 8613 - protein, 38 aa, synthetic construct
FLRYIQRLLKRFRQASNRACRSAQLAKLKQERQAGRYA

SEQ ID NO: 8614 - protein, 26 aa, synthetic construct
YLRLFPKFLRLLKHPLKKRYRHAFMR

SEQ ID NO: 8615 - protein, 68 aa, synthetic construct
RFKFLKRLLKMLHRRKSHAKLHARETKDLPEMRLCRLGKAHLELLSKFAWGGATGQMALAERALLLVK

SEQ ID NO: 8616 - protein, 85 aa, synthetic construct
RMKLLKRLIKYFRKGMAFALLEAYAFAKSKKALKHAQHVRPTKKYDLLILWEAKFNKVALRNRKAKLLCLSRGLRALPKVKHKMI

SEQ ID NO: 8617 - protein, 26 aa, synthetic construct
RMRMFCRLLRRIKNLTALRAQALSHH

SEQ ID NO: 8618 - protein, 32 aa, synthetic construct
LLRYLPRLLRKLTNRLKRRLATGRMYFARLRK

SEQ ID NO: 8619 - protein, 78 aa, synthetic construct
FLKLFKRLLKKWRKAGRLKLGLRQQKALFFYRMYVAKYKLRRKALAFEAKRSYAQNAHVGKWRQKHRNTKRAMDGLEL

SEQ ID NO: 8620 - protein, 20 aa, synthetic construct
KLRWWPRMIRLFRRLCLATM

SEQ ID NO: 8621 - protein, 40 aa, synthetic construct
RMKFWRKLMRMFPNCALKELKAAKKYKLIHARLHASIARR

SEQ ID NO: 8622 - protein, 41 aa, synthetic construct
KYKLLCRLFRLFRRWRARRGPALDAANQVERSSANKLVNVL

SEQ ID NO: 8623 - protein, 78 aa, synthetic construct
KWKLIRKFMRKMRRGLIALPGLKFYKAPKSVRAPLKNSAAPKRKNKGKAKTFKNLDAAYLWYLELQKHSNQAKLKCRF

SEQ ID NO: 8624 - protein, 29 aa, synthetic construct
RIRFMNKWWKRLRPANASAFKRRWLANAT

SEQ ID NO: 8625 - protein, 28 aa, synthetic construct
RYKLFNKYLKKIKKALAALMEKEWQAPG

SEQ ID NO: 8626 - protein, 27 aa, synthetic construct
KLRMYQRFWKMLRRLDLDMTRIAASLK

SEQ ID NO: 8627 - protein, 26 aa, synthetic construct
RLRILRKLLRWLRRAWLQYVEACPDI

SEQ ID NO: 8628 - protein, 58 aa, synthetic construct
FLRFWKKYLRKYTKLASRVRKGRVAELANLILVQSHAGLKGLLQKRRIKLRACAQTKR

SEQ ID NO: 8629 - protein, 50 aa, synthetic construct
MFKLMSKWLKLLRCAERLRKKALHLAKAMFLKDDERLSRMCDQRGWRFTL

SEQ ID NO: 8630 - protein, 81 aa, synthetic construct
KFRYMKRLYKFLTNRLERLGLAPRWLCMGLKGKQQRARKGKGKLAEIPLKARIFKAPRKDRRRLLEVPLHTYKKYLLRWAI

SEQ ID NO: 8631 - protein, 44 aa, synthetic construct
KFKLFNRIYRFLKSGQPLRRVLLALNHLRVRAKAKLTEKQLRMA

SEQ ID NO: 8632 - protein, 60 aa, synthetic construct
RWRMLNRMFKFLRPIKKTALWETKARLRRRYMKDELQLWKVLSARMVAAWVARYHLLNKA

SEQ ID NO: 8633 - protein, 58 aa, synthetic construct
KLKIFHRFFKFFKKQLKQKLLLCFSAKTSKQATAFAAAARARLSKYKLLYRIQRFGAA

SEQ ID NO: 8634 - protein, 49 aa, synthetic construct
KLRLLTKLMKKWRCKYAKFAALPRDEASSKTARFKFCHAHGRAGAGRAP

SEQ ID NO: 8635 - protein, 31 aa, synthetic construct
RFRWLSKMLKYYRKVAHQAKLNHKLRVFALR

SEQ ID NO: 8636 - protein, 40 aa, synthetic construct
RLRMWQRFMRRFSKMLLCLKKRLALAAKLLNPKKDTNLSR

SEQ ID NO: 8637 - protein, 29 aa, synthetic construct
FIRLFCKLLKKLKRLFALKRRRRLAKALC

SEQ ID NO: 8638 - protein, 28 aa, synthetic construct
FLRFLKKLFKMIHKKLDAGHKEKLALAM

SEQ ID NO: 8639 - protein, 50 aa, synthetic construct
RLKWIRKLLRYMQKRTSRRAATRLAALGAKMDIQHIFTKRHRLLLDQLPW

SEQ ID NO: 8640 - protein, 47 aa, synthetic construct
ILKMWKKYLRRWKKLFEWLKALHCARGRPCGKKKMARLCQREGMAAM

SEQ ID NO: 8641 - protein, 41 aa, synthetic construct
FLRFIPKFLRFLNCALAKHKMNRKATRKRLLRRKGVGAKRA

SEQ ID NO: 8642 - protein, 30 aa, synthetic construct
LIKIFKRLFRYLKKCVELIVLRCHKLRAKA

SEQ ID NO: 8643 - protein, 68 aa, synthetic construct
WLKFYKRYIRRLKRSAFALMWKVQYHKARLLAASALACNELNRAGKAALLNVTNRSIMEARSYKTKLL

SEQ ID NO: 8644 - protein, 43 aa, synthetic construct
LYKLLKRLLRKYKRRWEWGMGAALQKMSKKNCLWLPGALTHGK

SEQ ID NO: 8645 - protein, 33 aa, synthetic construct
RLKMFRKLLKRINKLALRLMKQKTLKDAQPTIK

SEQ ID NO: 8646 - protein, 25 aa, synthetic construct
LYKLLNRFLRRFKRALQTVKCCWRY

SEQ ID NO: 8647 - protein, 53 aa, synthetic construct
RLKYLTKFYRIYNRLRAPPWLHYRRRKMADQKKLHRRLKKACNAMLVKEALHL

SEQ ID NO: 8648 - protein, 25 aa, synthetic construct
MYKMLTRLMKKYKKLYLGRALKAFL

SEQ ID NO: 8649 - protein, 79 aa, synthetic construct
KWKYLCKLLRYFTKMRRRPDIKGFCALIAFKHKRKWHGEKWTLAADLALARRLVWSLPKKKRLRRGLHMKLSCRLAKSF

SEQ ID NO: 8650 - protein, 93 aa, synthetic construct
KLRYLRKIIRFMHCALKKYKYLRQRRAREHKGARRRMKLHYKYKRELRAAYMAAPIAKHYSREAKGPGLMTKLERALPAGRLCRTLAWRQHVE

SEQ ID NO: 8651 - protein, 30 aa, synthetic construct
KLRFIRKFWKIYSKAMLKAKHAAELDGDLL

SEQ ID NO: 8652 - protein, 43 aa, synthetic construct
KYKLMKKWLKMYKKLAQEKVPPHRMAMHRKTQQLRLLRAIAAN

SEQ ID NO: 8653 - protein, 38 aa, synthetic construct
RLRYLCRLLRKLRHEKMLRLERWLLNDRTTFKHHKAKL

SEQ ID NO: 8654 - protein, 83 aa, synthetic construct
KYKMFPRFYRKYKKGSFAAWIFNLQKRRRRVRILRKAKCFHVAAKLTKRYLLSADMALIAATHKMLLKRTNLMVRILLRLRML

SEQ ID NO: 8655 - protein, 25 aa, synthetic construct
LYKWMQRLLRIYPRKARALLTAKQA

SEQ ID NO: 8656 - protein, 64 aa, synthetic construct
LYRYWRKFFRKLRRARLLASANQWILLCMTRPLLALRFKAQKWAKSAKRDKYVAALAHIARAMM

SEQ ID NO: 8657 - protein, 35 aa, synthetic construct
MLRFLTRLWRKMNKRAKALKVDAYQAQYRTTLRAK

SEQ ID NO: 8658 - protein, 31 aa, synthetic construct
KYRLFKKLLRKYPRAQAQPLECAQRSAKTAL

SEQ ID NO: 8659 - protein, 45 aa, synthetic construct
KWRLMKKFYRFIQKLRELATEALWRSERRLLSLAANTFLHGRDRL

SEQ ID NO: 8660 - protein, 58 aa, synthetic construct
YYKLFRRFLRRLHCALLTKRFRKEFARWHDMKLLHLRGDRLNALTWCIRLRLRLAVKA

SEQ ID NO: 8661 - protein, 47 aa, synthetic construct
YWRLWTKYLKRMRNRKHQLNGRCLMAKYNVRVKAAKLHVALRRMLRA

SEQ ID NO: 8662 - protein, 40 aa, synthetic construct
FIKLLKRLYKYFRKEAQWLAQQDRAAALPKIMDRAKALKL

SEQ ID NO: 8663 - protein, 36 aa, synthetic construct
YFKYMRKLFKLMRKKIAGPNAIRTAETRVACALKLA

SEQ ID NO: 8664 - protein, 25 aa, synthetic construct
KFRIMSRLLRKIKKWAKLVLARCTA

SEQ ID NO: 8665 - protein, 53 aa, synthetic construct
RFRFLKRLLKRLHHHVAGAARLKARATSPGYQNARADIRYAPRLRLEERLDVC

SEQ ID NO: 8666 - protein, 45 aa, synthetic construct
LLRIIKRLFKWLTTKNKKTYPPMILNKLAAGRRMPLGLRKLRAED

SEQ ID NO: 8667 - protein, 25 aa, synthetic construct
YLKLWRRFYKRLKTRKLTSLFSHAN

SEQ ID NO: 8668 - protein, 41 aa, synthetic construct
KFKLLTKLIRRYRKMALRMLDYAALLRLMKIEEGAKLKLVR

SEQ ID NO: 8669 - protein, 56 aa, synthetic construct
RIKMLRKFFKRWKCLFVYFLKLHKKIFSRRLPEKWALYLYALLQLGRAKEVDRLLA

SEQ ID NO: 8670 - protein, 36 aa, synthetic construct
RLRLFRRMLKFIKKPACNKHPAQQLLMLHGRCAKRQ

SEQ ID NO: 8671 - protein, 76 aa, synthetic construct
ILRMIRRFFRRLKHLKRAHDQRPRRLAGALGHRSSPPKIKARAHLAFMLMDLRKNAPATRNLRCGIAHRNAISALA

SEQ ID NO: 8672 - protein, 47 aa, synthetic construct
FIKWFKRLLRRWTRILKLATIAEYKYLYLALRNAARDQMERRSSLMA

SEQ ID NO: 8673 - protein, 33 aa, synthetic construct
RLRILPRLWRKLRPLRNRWDSLPKVKLYQAASW

SEQ ID NO: 8674 - protein, 85 aa, synthetic construct
RLRILKKMMKRFKRYLGAETAPNSLHLEHRRALTCLSKALKAQAASLMRRQRIDIRAKARKKLCANMMPVKCLAMPKSQLIKMKD

SEQ ID NO: 8675 - protein, 25 aa, synthetic construct
KMKLMNKWLRRLKTVKQATFLSTKL

SEQ ID NO: 8676 - protein, 39 aa, synthetic construct
FYRLLKRIYKMLSRRNDTKAMLKKILNDKVARQLAMKAL

SEQ ID NO: 8677 - protein, 27 aa, synthetic construct
LLRFIRRLLRFMRQELKRKILRSLNHC

SEQ ID NO: 8678 - protein, 21 aa, synthetic construct
RWRFLPKILKRMKKSLLSPAC

SEQ ID NO: 8679 - protein, 63 aa, synthetic construct
WLRLIKKFLRWLRSKLYRARASNEKCALRLLARRRDAEMLALLTIKNIDYKKRSKEFTPAKEM

SEQ ID NO: 8680 - protein, 28 aa, synthetic construct
KIRWLKRILKLFTQVLKKRALLKMFYDA

SEQ ID NO: 8681 - protein, 40 aa, synthetic construct
RIKYLRKMYKKWKQKVLFAKHLLAKKCKAARLGKCLVLTI

SEQ ID NO: 8682 - protein, 53 aa, synthetic construct
LLKWMKRLLKLLTKKAFLYLDGDMARWTKMEYKALLRKMRRREENSLHLSLWQ

SEQ ID NO: 8683 - protein, 48 aa, synthetic construct
RFRLLKRFFKFLHKPKYKLNKGKKLAYRYTFACTTATLWRLTRKKAEA

SEQ ID NO: 8684 - protein, 29 aa, synthetic construct
RLRWIPKLIRFLRKRLPYWHALKTFEEKA

SEQ ID NO: 8685 - protein, 50 aa, synthetic construct
RLKFMKKYWKMWRKMALLTRLRLAMRAERLKVDNGRNQHALQKKKLARYC

SEQ ID NO: 8686 - protein, 50 aa, synthetic construct
ILKFFRRLYRLLRCMCHIRIRYMENAGRWRRAPMLAALALLLWRLRQRTP

SEQ ID NO: 8687 - protein, 93 aa, synthetic construct
RIRFFSRLLKKLKQLLQGAAAIKRALGLLQARRRRNHKALKRKEHNFRLAAIHLAKQTFFAFFRLRIMALSAKYVWQNPDYISRAANRRGRKV

SEQ ID NO: 8688 - protein, 34 aa, synthetic construct
RLRLFKKWFKRMNRFHWLASLLTARLDHIRMKGL

SEQ ID NO: 8689 - protein, 30 aa, synthetic construct
FFKLMRRLWRKMQRLALRIALLIRPYAEPQ

SEQ ID NO: 8690 - protein, 50 aa, synthetic construct
RLKMLRRLMRRITRLWTLRSAIAYYWRKRWLAEGKLLALPRLRAGARAKP

SEQ ID NO: 8691 - protein, 48 aa, synthetic construct
RLKYLKRLLRLLSPYEKPKKKWGASSRRKKHARHVVMALPAALLHIGG

SEQ ID NO: 8692 - protein, 59 aa, synthetic construct
KFKYLNKFLRLLCRFLLRQPSRNLHALLGLARKKGKKSIAKGWANYKHDRMRLGWIKRA

SEQ ID NO: 8693 - protein, 25 aa, synthetic construct
RLKLLRKWLRKWHKLVCHACPGLKA

SEQ ID NO: 8694 - protein, 25 aa, synthetic construct
KLRMWCKWLRWLSRRYKDDANLTAK

SEQ ID NO: 8695 - protein, 28 aa, synthetic construct
KFRMWKRLFKKYRRAPCAPLAVLLTTAR

SEQ ID NO: 8696 - protein, 29 aa, synthetic construct
MLRILRRYMKKLRQIKKASKPAAQNCQLM

SEQ ID NO: 8697 - protein, 52 aa, synthetic construct
IFRLLSKLLRILRNALKASLRVSKAVAYSYALKCNKKARNKKKAMRDNTLVA

SEQ ID NO: 8698 - protein, 81 aa, synthetic construct
KWRLYTKILKKIRKEPYRYLNNVALLRWYLYLRRHHKMIAKPHLLMATACRLYFALRLDDKQRCRLAAHKGKKRGWKTKRH

SEQ ID NO: 8699 - protein, 21 aa, synthetic construct
RYKLLRKLLRRITPRMTAAWL

SEQ ID NO: 8700 - protein, 24 aa, synthetic construct
MFRLFRKYMRMLRHRKAANTTLKL

SEQ ID NO: 8701 - protein, 23 aa, synthetic construct
KYKFLQRYFRRFCSFARHLALLK

SEQ ID NO: 8702 - protein, 47 aa, synthetic construct
KFKFMCKLYKIIKRTALALQLRRWQKMLQRQPRLLADSRKALRIPWG

SEQ ID NO: 8703 - protein, 57 aa, synthetic construct
RWKWLHRLLRRLTKAKKLMIFRFLRCAARGIRLLKERKRVCWAYRLEGARESVWCKP

SEQ ID NO: 8704 - protein, 25 aa, synthetic construct
KIKIYTKLLRKWRKRVALADDVLAK

SEQ ID NO: 8705 - protein, 35 aa, synthetic construct
KYRLYKKWIRKFRRKMRDLRTALVLGVANCLAANS

SEQ ID NO: 8706 - protein, 38 aa, synthetic construct
YLRLLSRYLKYWRRKSSKRLPASRRFRAQYGARIAQHM

SEQ ID NO: 8707 - protein, 52 aa, synthetic construct
RFRFLKKLWKKMSRRRQWRKARCLHRRKLGCALAMIALIFEEYLLEKFFSRF

SEQ ID NO: 8708 - protein, 34 aa, synthetic construct
ILKWLKKFIRRWSRLARRLLATEMLRLTNLDWLM

SEQ ID NO: 8709 - protein, 28 aa, synthetic construct
FIRYLKKLIKKMKKLLARKAAARLFWKA

SEQ ID NO: 8710 - protein, 77 aa, synthetic construct
FMRFIKKLIKLLKRSKANQLAQQWPRGFGIDFKRLAKGKRILQNAARNRTAALVRALKFRAVDRRALDHLALHQYLH

SEQ ID NO: 8711 - protein, 97 aa, synthetic construct
YFKYIPKMLRKLRHTVYRRAAVAKVRKTKLLTEASGRHSAKHCKKLMSLRSLLRKCCFRFAKKALVRDMLKACYRLALGLRQCNCLAYRKAYASRNR

SEQ ID NO: 8712 - protein, 27 aa, synthetic construct
KMKLWRKLFRRFTKMAALKTRCELAQL

SEQ ID NO: 8713 - protein, 65 aa, synthetic construct
LFKLLRKLWRKMRKRAKALRAKLSKKAKVGLNRQIGGNRARWCKCQCRAHKLGFKSVSALAIDRV

SEQ ID NO: 8714 - protein, 36 aa, synthetic construct
KFRLLKKIFRFYKRLRLRRFISNMRDLASDVHAAAA

SEQ ID NO: 8715 - protein, 43 aa, synthetic construct
LFRIWKKYFKYLQKVTAKCLKRRYRDLRKLLLMWSYRAGAHSL

SEQ ID NO: 8716 - protein, 67 aa, synthetic construct
MYKILNKFFRLYKHLKYPKQKRLNSLAMDKQVLKRSMKKRLAAQRHILHALLRLYDKKERRLRWHAK

SEQ ID NO: 8717 - protein, 20 aa, synthetic construct
LFRYLKKLLRKFPRLVCGRV

SEQ ID NO: 8718 - protein, 63 aa, synthetic construct
RIRLLRKLLRLLRNIMRTNIARHLARIAMAMRLRRKKTWAYIRQLKLNQALWGMKKHLYCVLV

SEQ ID NO: 8719 - protein, 41 aa, synthetic construct
RLRFMKRLLKKFKSQERLLKVTEMARLNSRKQIARAHALCW

SEQ ID NO: 8720 - protein, 21 aa, synthetic construct
FLKLLRKLLKYLKKKSMKELR

SEQ ID NO: 8721 - protein, 34 aa, synthetic construct
KLRFLKRLMRRWPSRYLRLRMACAKYIRAAAYRA

SEQ ID NO: 8722 - protein, 81 aa, synthetic construct
KLKLYKRLYRYFKHYQADDKRRAYARKKAVIATSRRAKWATLKFKNLLDEKKATSCAGHSLKKHKLLLLNVDHSKCPKRSQ

SEQ ID NO: 8723 - protein, 27 aa, synthetic construct
KLRWLQKWIRKFTQQARYKNAAARAYQ

SEQ ID NO: 8724 - protein, 40 aa, synthetic construct
FFKLYKRMIRKWPSKAWLLWRKAKLMDTLKWVHAARQVRR

SEQ ID NO: 8725 - protein, 29 aa, synthetic construct
LYRLIRRWFRRFNKALAITAAKHRQSQRA

SEQ ID NO: 8726 - protein, 24 aa, synthetic construct
RLKLWRKMMKLFSHNAADTKLRWA

SEQ ID NO: 8727 - protein, 77 aa, synthetic construct
RLKWWKRWLRKMNKKEILLHLRRSRKKKTAFWHIPKAAKYFHALKADLLMQCRPNAARTGRFIEMQAGARLLELAAM

SEQ ID NO: 8728 - protein, 31 aa, synthetic construct
LLRYINRLLKFLRKELQLRTIWAWNRLKLKK

SEQ ID NO: 8729 - protein, 36 aa, synthetic construct
KWRLWKRIFRKLKKIRSFTSKPEALNKIALMAIARA

SEQ ID NO: 8730 - protein, 51 aa, synthetic construct
LLKLWKKMIKLYQKACKKLRLPNCARNRALKRLKGYKELVLWMKRHAWPRA

SEQ ID NO: 8731 - protein, 60 aa, synthetic construct
KLKLLKRMFRKLKKCLYLLRAQPQSCALTWRVCAAELRLLCKKQRALKARWSWLGVGCER

SEQ ID NO: 8732 - protein, 70 aa, synthetic construct
RWKIYPRYYRKFCRRFCALLLAMPYKCLKAEAKTMMVALALAVGRAKKLKRKKLHSDKYKLMRYIKEQRA

SEQ ID NO: 8733 - protein, 20 aa, synthetic construct
RWKFLKKLFKLFQHAKRTLT

SEQ ID NO: 8734 - protein, 52 aa, synthetic construct
RLKMIKKWLRLMHRNAIAKAKETDLTAAPALKRAYAVIFSFLKYQRKHKKCQ

SEQ ID NO: 8735 - protein, 34 aa, synthetic construct
KYRWMKKILRLFKKTWARAFNALLRCLLIHYGHR

SEQ ID NO: 8736 - protein, 71 aa, synthetic construct
KFRILRRYMKKWSNSLAKGAGSAAACAVHRARRASRAAAALFNRGPWLKAVCEKRLLWMCLRLKRFAIRRW

SEQ ID NO: 8737 - protein, 43 aa, synthetic construct
LFKLYKKLYKRWHQSQKRKRKMRAICNLLAKSLHWATCKIAWA

SEQ ID NO: 8738 - protein, 41 aa, synthetic construct
YLRLWQRLFKMLRPGSKPRNLKAYAITLALRIHRHLAASMK

SEQ ID NO: 8739 - protein, 65 aa, synthetic construct
WIRIWSRLFRMWNRTALAQPNALKLAAKRKCRYRSKALVNWARLKIARKNDRSRKRAPRLDRKQA

SEQ ID NO: 8740 - protein, 74 aa, synthetic construct
KYKLYKKWYKKLRCIPRQHKKCRDNEAPLPALKAKHAKYQASKAMYRRQANAYELKCRWKRKEIAKLARLARRA

SEQ ID NO: 8741 - protein, 52 aa, synthetic construct
IFKLWTKFFKRYRPRMKIIRLLKRRYLENLGRRWAWQRCGAALADLLANRRN

SEQ ID NO: 8742 - protein, 88 aa, synthetic construct
LFRIYKKFFRLLKCHREAVASARKCLEKKLRQKAWMYVKLERDLASKAAAKNYRYQNKTAKAERATRIKAIRTRRFKYRLKCWKATLL

SEQ ID NO: 8743 - protein, 38 aa, synthetic construct
RWKILRKFIRFFRPVERARALDLRNLRLFRMVTLCWLA

SEQ ID NO: 8744 - protein, 24 aa, synthetic construct
LWRLLKKFYKRIQNAARQSKKLLN

SEQ ID NO: 8745 - protein, 68 aa, synthetic construct
KIKILKRYMRYLCKAGKKWKRWRLLFGIKKKHAARRKLMCRVKLRHLVRAQFKFALTALAHDAARTKY

SEQ ID NO: 8746 - protein, 55 aa, synthetic construct
IFKFFKKMWKLFKKARASKRALVRMGHKKLTTPRPLASVDRVAEDLKCARACKKA

SEQ ID NO: 8747 - protein, 30 aa, synthetic construct
KLKFLTRFLKKLKRARACRLQLCQAYARFT

SEQ ID NO: 8748 - protein, 24 aa, synthetic construct
KLKILCKFYRRFSCALAKKNKLFS

SEQ ID NO: 8749 - protein, 32 aa, synthetic construct
LYRMLRRWLRRFSTRLAALDWYLAKFVRGTMA

SEQ ID NO: 8750 - protein, 32 aa, synthetic construct
FLRFLHRLWRRYKKNKKLCYTKTARCAAAGLK

SEQ ID NO: 8751 - protein, 21 aa, synthetic construct
YLRLLRRYWRFIRQATNKRPA

SEQ ID NO: 8752 - protein, 40 aa, synthetic construct
YLRYLHKILRRMRRLIQLESHLQKFATRILPIKNKKKGLA

SEQ ID NO: 8753 - protein, 32 aa, synthetic construct
FLRLFRKYLRWFRQQWSLIDKRAASLVVARLL

SEQ ID NO: 8754 - protein, 52 aa, synthetic construct
RWRWLRKWWRRFKRQLKKALIFVCTQGAGRLLLRKAPRAPKACTALCLWGLS

SEQ ID NO: 8755 - protein, 27 aa, synthetic construct
KLKIFKRLLKFLKRAAYALLTRKFRAD

SEQ ID NO: 8756 - protein, 50 aa, synthetic construct
RLRMMCKYMRFFKKLLRGHAAAAKKLHPPPKNCYATKLLHWCRKRVKAAE

SEQ ID NO: 8757 - protein, 32 aa, synthetic construct
LLKLFKKMLKYLKSAAWCHQCERIRLMKYSKA

SEQ ID NO: 8758 - protein, 45 aa, synthetic construct
KYRIYRKYLRFLKRTMKATIILQARLANRKQKMPSAQVKALTKYL

SEQ ID NO: 8759 - protein, 66 aa, synthetic construct
WLKLLCKWLKRYRRLRHTALKMKARIHAYKCTRMALRKAKFPPKLAAARAKWKLYMLYPHKEGWDL

SEQ ID NO: 8760 - protein, 33 aa, synthetic construct
LLRLFKKFLRYLRRKAGFDRRFAMAKRLIQPMA

SEQ ID NO: 8761 - protein, 33 aa, synthetic construct
MFKLYRKLLRKYRTNLLKVHLAKWCLERLANYW

SEQ ID NO: 8762 - protein, 22 aa, synthetic construct
IFKLLRKFMRKFQPAAALLPKH

SEQ ID NO: 8763 - protein, 34 aa, synthetic construct
FFRMMRRWFKRWKKRTLDPLAALIRYRPAQALIL

SEQ ID NO: 8764 - protein, 88 aa, synthetic construct
MYRMITKFIKRYNRNAPGSATRMRAFQYKEFMAKMPAKMKRWKKLALAHRRALLARANMRKLEICERYTLRAKKPKALRKYKRNWALC

SEQ ID NO: 8765 - protein, 23 aa, synthetic construct
KIKWYRKLFRKLTRRAGKAAAQA

SEQ ID NO: 8766 - protein, 59 aa, synthetic construct
FFRLLTRFWKRFPKDAKWLLYKLEKERRWKLLKGWYRKRKRVCLWILNLWYAVKALEEL

SEQ ID NO: 8767 - protein, 70 aa, synthetic construct
LLRIFKRMFKRLKPTRNLKCQNLMGFYYLPLATRMERLLLLLKCTAERRIAKTTQGAAAASTMLMRRLAA

SEQ ID NO: 8768 - protein, 25 aa, synthetic construct
FYKLIPRFWRRFKKCAKKSLLAGLD

SEQ ID NO: 8769 - protein, 66 aa, synthetic construct
KYRLYRRIFRKLCSARHAYIKAAFIRGGIYLALRTNRLWEAGLDRRIRDLLRKEERTANCKLMLRA

SEQ ID NO: 8770 - protein, 21 aa, synthetic construct
RWKFLPKLLRRFRRNCAKLAA

SEQ ID NO: 8771 - protein, 82 aa, synthetic construct
FLKMIPKFLKWLHTRSALRRLAKRTWIKKDAMNLKKLKAACCLLLRAWCNDDCTALCDKYRRAHARACASLTARARVQRIKA

SEQ ID NO: 8772 - protein, 26 aa, synthetic construct
RFRLFKKMLRRITRALARALIIAMQW

SEQ ID NO: 8773 - protein, 39 aa, synthetic construct
KMRLLRKLLKKMHPKKTFARALLQTHSCRLKWALALVDG

SEQ ID NO: 8774 - protein, 93 aa, synthetic construct
RLRLWCKLMKKFNKSAAYFLKYLKREFLAKVLLKFLYVKLRAKKAFMRVKLKIARRRASRKMRACTLSMFHIIATLSKRCCLARQMVGMWPAY

SEQ ID NO: 8775 - protein, 34 aa, synthetic construct
LFRLYRKILKRLPHHWLRLRTKCAYYKGLLRNKR

SEQ ID NO: 8776 - protein, 32 aa, synthetic construct
RLKFFSRLLRKIKRKFCARRMHLALVCDAKLN

SEQ ID NO: 8777 - protein, 42 aa, synthetic construct
KFKFLTRLFRLLRKAKYLVLCADLRKHREPAVMLALDWFKAK

SEQ ID NO: 8778 - protein, 60 aa, synthetic construct
KWRYLHRYMRWFQKLRLMLHAYRKRLDARAANSYRAAWRAALERKRNMQGSCYPLILKSA

SEQ ID NO: 8779 - protein, 47 aa, synthetic construct
LLKLWKRYLKFLKTNKKRYALQTHQCAKTRNKRVKLLRLTDRVAVTR

SEQ ID NO: 8780 - protein, 38 aa, synthetic construct
IFRLFRRFLKLLRKRQDKERLHRALNRLLWAAPKMPFD

SEQ ID NO: 8781 - protein, 37 aa, synthetic construct
KLKWMRKLLRRLCKLTIYCLAHTAKRLDKAGRVVLLA

SEQ ID NO: 8782 - protein, 28 aa, synthetic construct
YLKWLKKYLRFLRKAVQKKAATLKSNSW

SEQ ID NO: 8783 - protein, 28 aa, synthetic construct
KMKLYKRWFKLYRRRGEAILYILLLPSR

SEQ ID NO: 8784 - protein, 27 aa, synthetic construct
KWKLYPKWIRRWTRLKAAQSLYIASAR

SEQ ID NO: 8785 - protein, 34 aa, synthetic construct
KFKLWKRMLKWLKRYLKGDGGMLFLTKLYKLFLE

SEQ ID NO: 8786 - protein, 52 aa, synthetic construct
KFRMLNKILKFWQKTHKQELKRHVQGKPKLKRLFRFAARGTLLHTLARLRAL

SEQ ID NO: 8787 - protein, 60 aa, synthetic construct
FFKLWHRWYRFINKDHALKAPKISANRRKLQLRKWAIEALKQLRADDKHKLRAPKQAKQD

SEQ ID NO: 8788 - protein, 32 aa, synthetic construct
RMKFMRRIFRFWKNALALKAWALQLQKCSKRP

SEQ ID NO: 8789 - protein, 39 aa, synthetic construct
KMKFIRRLMKKLRRKRAHGMAHLCQARAHLTGDPPKILL

SEQ ID NO: 8790 - protein, 79 aa, synthetic construct
KLRLLNRLLRYFRKLAKLQDLAEVKWAKWFLQLLVWLDAKTERGLGWISALGAKADLYKAPCIWRKYAHRAKPKMDRIF

SEQ ID NO: 8791 - protein, 68 aa, synthetic construct
RLKYWQKLLKILTKLKRCKNQASFHAPPWAYRLCSGRKRALYMIPRRFCTKLRKLTMDRLMMLKRARL

SEQ ID NO: 8792 - protein, 63 aa, synthetic construct
YYRMFRRFIRKLKPANYWAKILCRLAGLARKLHQERRRACSAAKIKLCRMLERDARYNYICLR

SEQ ID NO: 8793 - protein, 57 aa, synthetic construct
RWRWYRRLLKRWCNSAKPIRQAACRLATLHSKRHCLKAPLLAAPADRKGKKSRRMHE

SEQ ID NO: 8794 - protein, 59 aa, synthetic construct
RLRMLRRLLRFFKCNHPHAALKLWIKLQACALKREKQATTKFRCANPMCQKRLVALKKL

SEQ ID NO: 8795 - protein, 74 aa, synthetic construct
RLRLYRRFMRKLKCKANYLLKKAKWYKKCKRTQKILRAIEVMRYRALPLLENQCSKLQARAHDRAHALIALDAG

SEQ ID NO: 8796 - protein, 34 aa, synthetic construct
RFRLLKKLLRRFRSLDGQKAYALMWLRFELDKYW

SEQ ID NO: 8797 - protein, 76 aa, synthetic construct
KLRLLTKFWKRWKKFLISKRLEIASELTRLWAKFCWAHENHQDMAANGNYAKQLAAAADEKLAKKKKQLALKGRLR

SEQ ID NO: 8798 - protein, 41 aa, synthetic construct
RLRLLNKFYKWLTKQVLLCKNSSKQALKAAKCHPWHAAERA

SEQ ID NO: 8799 - protein, 23 aa, synthetic construct
KMKFLKKLLKLLSCCYALFVRQK

SEQ ID NO: 8800 - protein, 28 aa, synthetic construct
LLRIMRRFLRKLKRNWLSLQRLWGLFDQ

SEQ ID NO: 8801 - protein, 31 aa, synthetic construct
FFKLIKKYLRRLNTVRALRARATEILKLRRL

SEQ ID NO: 8802 - protein, 41 aa, synthetic construct
RLRLWKKILKLYRNNLATNSFRSHAFLAWKQQTKANALKKA

SEQ ID NO: 8803 - protein, 47 aa, synthetic construct
MFKYMRKFLKRLKHYRLWPACKRAKNKPFLKPPLKYMAMLAKLALNH

SEQ ID NO: 8804 - protein, 42 aa, synthetic construct
LWKFYCKYWRKLQNFRKPEKRKRLLRFWLKLATKADFLLKKL

SEQ ID NO: 8805 - protein, 69 aa, synthetic construct
RLKFLSKIWRFLRKKRALLVKRAPPNLPKYRDAYMPLKRPTLFQKICIFHHRARARLAPQKRLDIRFGL

SEQ ID NO: 8806 - protein, 31 aa, synthetic construct
RLKFWPRLLRFIKRKLTLQACARAKYIYCFK

SEQ ID NO: 8807 - protein, 43 aa, synthetic construct
KIKLMKRLLRRLKRRCDNMALQAQHMLAKKCKVPLRMVICAAP

SEQ ID NO: 8808 - protein, 38 aa, synthetic construct
LLRLWKRLFRFWKRARLLCFLKVRRNMLPKAMRRRWFL

SEQ ID NO: 8809 - protein, 30 aa, synthetic construct
ILKLMKRLLKRWTNKREVYLLKKLCPLRYL

SEQ ID NO: 8810 - protein, 49 aa, synthetic construct
FWKLMTRLLRYMRRELIASHLARIWKRKLIACQKRFLIRAKLDAYENAY

SEQ ID NO: 8811 - protein, 34 aa, synthetic construct
MLKILTKLFRKLPKGKLTKRRRPASHLGALCCVL

SEQ ID NO: 8812 - protein, 49 aa, synthetic construct
KYKYLRRLLKYLKRYAAPWAAELSLFGCLKRLAKKNRHKQLFDSRKWSA

SEQ ID NO: 8813 - protein, 51 aa, synthetic construct
YIRLFKRMFRYWKRLQLKLDAKMAPKAIGRAVRTPRAAQAKLKNMAKKYFM

SEQ ID NO: 8814 - protein, 44 aa, synthetic construct
LLKYLTKWLKRLKTQAKPRNRVAAKKKLALKKARYKLYDGIELA

SEQ ID NO: 8815 - protein, 63 aa, synthetic construct
IWKWLKKLFRLLKKKEVFFVRRLILLMKADYKIAKHAWLWRACLVLLNRFPAHLYKQHKHKAF

SEQ ID NO: 8816 - protein, 89 aa, synthetic construct
RLKFMRKLIRKWKSIRIKARLARMMRSSNWAYVACAKKCADKGGKHIKVRAAKAATLHKRKTRAVALSWEALKNTGAVIRARLKMFKFC

SEQ ID NO: 8817 - protein, 51 aa, synthetic construct
KLKYWRKFYKLWRRLIRQKSKDCRAGTLLKPSRKPNNRHCRRPAHAAWALL

SEQ ID NO: 8818 - protein, 35 aa, synthetic construct
LLRILQRWLRKLKKTILQAVAMKRERKWKTLADAH

SEQ ID NO: 8819 - protein, 40 aa, synthetic construct
RLRLLRRWLKRFSRLQSRELAKLIMFLACLARRCLKRKKD

SEQ ID NO: 8820 - protein, 75 aa, synthetic construct
RLKLFKRLLKKLNRWRVNGPRERLEPRKKAALAHCRWAEEKKMVCADAARKVRALQRLHLANNLKRKGKERAVLR

SEQ ID NO: 8821 - protein, 40 aa, synthetic construct
RFKLMCKWLRKYRPAEARLERTKAWIMMAGRKALICLSAW

SEQ ID NO: 8822 - protein, 49 aa, synthetic construct
KIKLWTRWWKKWRRKHCPVKPMNRADLMLLKKLRHAQFLARKVAVARLA

SEQ ID NO: 8823 - protein, 35 aa, synthetic construct
FLRFMCKFMKWLKKKAPRSDVLRALNRLRRRTLLM

SEQ ID NO: 8824 - protein, 22 aa, synthetic construct
KLRFMRRIWKLLHRLKITAALN

SEQ ID NO: 8825 - protein, 20 aa, synthetic construct
KIRWYSRLIKLLRHSLDRDA

SEQ ID NO: 8826 - protein, 61 aa, synthetic construct
KWRMLRRYMRRWSKAFITRRLAKRAKCHASESEMSKRLGRACRRNKLKANARKHALIFAAL

SEQ ID NO: 8827 - protein, 42 aa, synthetic construct
IMKLYQRYMRYLRTGLQRRAAARALWLAANFHVRAWRKKAAV

SEQ ID NO: 8828 - protein, 66 aa, synthetic construct
KYKFWRKLLRMWRCQRIDPHLKLNTKLLKVKTKSLSAAFSQLGKTRWALLDLTVARKRPLLLFKKK

SEQ ID NO: 8829 - protein, 80 aa, synthetic construct
YLKLMKRFLKRWPSEKKLGAYFQREKHMNKFTNWRLIGYSKLRLLWVAKQKWARLTRSRRLRDPNPAPAKLLPSKKLKKL

SEQ ID NO: 8830 - protein, 31 aa, synthetic construct
KWRFLNKLWRFLKSCLLAYALTRARKALEWI

SEQ ID NO: 8831 - protein, 32 aa, synthetic construct
FLRLLSRFLKMFKKRHAKSTARLHDIKAKDTI

SEQ ID NO: 8832 - protein, 50 aa, synthetic construct
KLRIFHKLLRRFRKLALKFLKKPAVNQHYKGTLMERPKDLELALVRVGAK

SEQ ID NO: 8833 - protein, 20 aa, synthetic construct
RLKLLKKWWKFLRNKDLHCI

SEQ ID NO: 8834 - protein, 69 aa, synthetic construct
KLRLMKKMFKILNQVKRRLGAHRQLKLLKWFKSKAGASRRAMWVYYGILALRWQLAKLQQHKIRKANLH

SEQ ID NO: 8835 - protein, 52 aa, synthetic construct
RWKLWKKIFKRFHTLARQILKESKIADKAKRRFLWNLPATCATRYLGLAAAE

SEQ ID NO: 8836 - protein, 20 aa, synthetic construct
MLKFYQRLWRWLKRRINAPA

SEQ ID NO: 8837 - protein, 51 aa, synthetic construct
KYRLMRKMLKKFCCSLKLAQHVANLRKAHNAKADPWAAYAWRRCPNPKKRR

SEQ ID NO: 8838 - protein, 38 aa, synthetic construct
RLRWYQKWFKKMHKAALRLRLLAHKQKRWCVPTKLLLF

SEQ ID NO: 8839 - protein, 32 aa, synthetic construct
LLRMLNKMFKKLRNLRSITKASARPRSARNLN

SEQ ID NO: 8840 - protein, 36 aa, synthetic construct
RYRWWKRLLRLLRHCSNELRRALLLLQCKRGSEHGL

SEQ ID NO: 8841 - protein, 25 aa, synthetic construct
MLKWLKRFLKRYKKLPEIDNSLVLL

SEQ ID NO: 8842 - protein, 36 aa, synthetic construct
RLRFMKRYLRKWRSALCKIRELLIRRADQGEACLWI

SEQ ID NO: 8843 - protein, 30 aa, synthetic construct
KWRFLQRFIKLMRKAAKPDLMLKPRKALCL

SEQ ID NO: 8844 - protein, 36 aa, synthetic construct
KLRWFKRWLRLITKRMAAQHVANLRAAQKRRKSAHL

SEQ ID NO: 8845 - protein, 97 aa, synthetic construct
RLKWIKRLFRKLHRHAACQERSRQLAFLKYLKTATRTTKHAYAAMIELKAVTVKDGAADGYRPALTLLRLEWKLLEGAPKARCSAEKKAVFFKMKRR

SEQ ID NO: 8846 - protein, 50 aa, synthetic construct
RLRLLRRLLKRLQQTLAPHFTADQRRRLNRYCVAGAKEEPFICALAIKAT

SEQ ID NO: 8847 - protein, 92 aa, synthetic construct
FWRFYKRYLKRYPKKAMARRRSKMFKALNLYYLKAIALYDNNAATGSSACWDYQACASLQGLLAKLRKKRVKRRPFRSVKFKKLLLTLLEMK

SEQ ID NO: 8848 - protein, 30 aa, synthetic construct
ILRIISRMFRILKRLHALTRLAKTKGLLAL

SEQ ID NO: 8849 - protein, 39 aa, synthetic construct
RLKILRKIIRFMKKGYKVRRRLCAAALDWHCPGDYAKLL

SEQ ID NO: 8850 - protein, 21 aa, synthetic construct
RFRLLNKIWRKFSRLLEYLMA

SEQ ID NO: 8851 - protein, 43 aa, synthetic construct
RLRYMNRYFKRFCRWLTWRVLILWRRAATLSPNRAWRLRLKKD

SEQ ID NO: 8852 - protein, 36 aa, synthetic construct
YFKMLKRFWRKWRHAAAAPAKDAGDKHNAAATKDQL

SEQ ID NO: 8853 - protein, 23 aa, synthetic construct
KLRIIRKWLRKMRCLLKRAALNL

SEQ ID NO: 8854 - protein, 28 aa, synthetic construct
RYKILKRLYRKFQKAYHGQLAASLPRKI

SEQ ID NO: 8855 - protein, 30 aa, synthetic construct
LMRFYSRLWKKFPHRRAAPRNDAAKACAAW

SEQ ID NO: 8856 - protein, 44 aa, synthetic construct
YLKYFKKLLRLWKHRLMRQKKHEGELILAWKLRLLIARWDKLCR

SEQ ID NO: 8857 - protein, 75 aa, synthetic construct
LLRLFPRLYRRLPKFRLQGACKRWCAPLRKKKLDHSQDQEKDQLDTLWKTAFILWAKIKEAELALKMKAGLQLRL

SEQ ID NO: 8858 - protein, 31 aa, synthetic construct
LFKFYRRLLRKFRCKRALLDIFLTKAVAYET

SEQ ID NO: 8859 - protein, 39 aa, synthetic construct
RWKLWKKLLKLYKHKNVLQRLLAEARRILQKLKGHKKLR

SEQ ID NO: 8860 - protein, 20 aa, synthetic construct
LFRLLRKYLKMIRRMRPSLT

SEQ ID NO: 8861 - protein, 38 aa, synthetic construct
RFRLLKRMLRLFRCADRLNKRATYNLIQGLLAKSRRKT

SEQ ID NO: 8862 - protein, 26 aa, synthetic construct
MFRILKRLFKRLRTKLGCLAKHLLAM

SEQ ID NO: 8863 - protein, 42 aa, synthetic construct
RLKMLRKFLRKWTRASFKAAGAAKQHLCWMAASPRYRRVTIK

SEQ ID NO: 8864 - protein, 30 aa, synthetic construct
RLRYLKRWLKKLPHPDRFTWAAKAAAWQKD

SEQ ID NO: 8865 - protein, 37 aa, synthetic construct
FLKYFRKILKLFNNHAAWRTKLKNILLASWLHLLKRK

SEQ ID NO: 8866 - protein, 41 aa, synthetic construct
KWKMICRIYRRLSKRGRALPARALKAITVPMFVTRAERARA

SEQ ID NO: 8867 - protein, 20 aa, synthetic construct
KMRFLRRFLRRLRCYITHAA

SEQ ID NO: 8868 - protein, 66 aa, synthetic construct
LLKYMRKLWKLISSGRAAEHRLIVKRLMRLSAALEARKYTFQRDCLAQHIRRKMGALCYAIKKKTK

SEQ ID NO: 8869 - protein, 99 aa, synthetic construct
WIKLWRKLFKFLRKTRLLSPHARTAKKYARPACVHYRAFLLMAMENRPRKIAGYELNNALKDRQMYKLARKKSHTRHKFRRCFTAILTPKLARRAKLRS

SEQ ID NO: 8870 - protein, 78 aa, synthetic construct
KLRIMKRLLRLLQKIAAQVHWKNALKKKSALRLLRLLIQFKALVALRVLWWAVATYRKIEFAQAGGLMKFKAKANKKR

SEQ ID NO: 8871 - protein, 26 aa, synthetic construct
MYKYLSRLMRWLQSARLLARLFKCRR

SEQ ID NO: 8872 - protein, 65 aa, synthetic construct
KYKILRKLLKMLKKPKKMNLWKLAMSAQKMSHRMLKRTASIRITANKAKCVSKRQARRLLQKMFA

SEQ ID NO: 8873 - protein, 82 aa, synthetic construct
KWKILKRLLKFYRQADCGILFLKACAKALKTLKILLKDRPCRKFIALKHKKVFYDRQRRLQPKQHWKAMIAIPKAAIKHHKK

SEQ ID NO: 8874 - protein, 20 aa, synthetic construct
LLRFFPKLLRMFTKAGARGR

SEQ ID NO: 8875 - protein, 38 aa, synthetic construct
LWRLIKRFFKKIHKLLNTREPALLTLKLRKRADRRMAP

SEQ ID NO: 8876 - protein, 30 aa, synthetic construct
LLKFLKKLLRFLKKKKLCSAQQRACAVDKV

SEQ ID NO: 8877 - protein, 36 aa, synthetic construct
KLRIWNRLWRRFNKLLLFLLSKIALATGRCTYRKLK

SEQ ID NO: 8878 - protein, 74 aa, synthetic construct
LFKLLTRYLRRLRKKKKLYGLADTIAILKMGNDLKKDQANSWRRRKAKSEHDLRLAHVKSLVAKILAMNVVHAC

SEQ ID NO: 8879 - protein, 49 aa, synthetic construct
MIKLIKKLIKRIQKNMKYSKCPRQAVKDAALALAYEAKKARPKHLHRAE

SEQ ID NO: 8880 - protein, 56 aa, synthetic construct
KLKMFKRILKLFRRAAAACKARVIALIKLNCESEGHAMPRMQRIARLALCLKVKNC

SEQ ID NO: 8881 - protein, 29 aa, synthetic construct
YMRLYSRMLKIIKKNLNAVATKLAHKCKA

SEQ ID NO: 8882 - protein, 30 aa, synthetic construct
IIKILCKLLKILRKWLTAIYKLMKHRLAHM

SEQ ID NO: 8883 - protein, 32 aa, synthetic construct
KYKFLPRLFKLIRRKLDRHSAWLKAITGAKKL

SEQ ID NO: 8884 - protein, 100 aa, synthetic construct
RYKMLRRIMRRLTKKFAWCWMLPRRERAKKRALPVYLIALAFKKALLACALEALYDANFLAPLKRAMNAKMRDALLVLRTHGLAVLKKFKDTNMWYYKTK

SEQ ID NO: 8885 - protein, 23 aa, synthetic construct
IFKLLKKFLRRLTCQQPKRLAYC

SEQ ID NO: 8886 - protein, 49 aa, synthetic construct
RFRYYRRWYKKWKKLIAGILAARDNRRSWKALYIKLLIKAWANCRLYDM

SEQ ID NO: 8887 - protein, 34 aa, synthetic construct
KLRLIKRLYKRICCTAAVKMKIWAVQVLKALQHA

SEQ ID NO: 8888 - protein, 25 aa, synthetic construct
RLRFFRRLLRLLHRMLKYATYMDYD

SEQ ID NO: 8889 - protein, 26 aa, synthetic construct
KLRLFRKYLRKMRRFKSRTAAAALNM

SEQ ID NO: 8890 - protein, 47 aa, synthetic construct
WFRYLHRLMRLLNKRARAGAGAWMERSTIAVLRCLRLRANACYYKEA

SEQ ID NO: 8891 - protein, 34 aa, synthetic construct
LYRLYRKLMKFLRKALLVNRITEHAILKRSKYQA

SEQ ID NO: 8892 - protein, 67 aa, synthetic construct
FFKMISKFYKKIKSQFALLLLRKKCADMARLRFCGLVAAFSNTRCLWRAHLSHRARRRTAKKDLVLL

SEQ ID NO: 8893 - protein, 20 aa, synthetic construct
WIRMLKRLLKLFRKAIAWEQ

SEQ ID NO: 8894 - protein, 68 aa, synthetic construct
LWKYFKRMWRRLRRAWQGLKLRYLWKRGAALAAGYLKARCRIAKAQAIMKLKYHRRAKGGTGFAHVIM

SEQ ID NO: 8895 - protein, 30 aa, synthetic construct
MFKLFKKYLKKMRQALKLAKKAHRFLECED

SEQ ID NO: 8896 - protein, 38 aa, synthetic construct
KLKYYHKIMRLLQRLAKLKRWTRRVFGAVGDHALLKHL

SEQ ID NO: 8897 - protein, 41 aa, synthetic construct
MIKLIRKYWKRLRRPTCKHLALRAMRLKTLKIRLLARYFAC

SEQ ID NO: 8898 - protein, 64 aa, synthetic construct
LWKFINRLLRRFHRHKLDFRLVLCCMLKRKLQRANRYVLWWMIKDRKILWKRLDLDAPEKARRA

SEQ ID NO: 8899 - protein, 70 aa, synthetic construct
LLRFLRKLLKRYRRPPERKDLEAANCTTLGKAGLNLARMRHRFARALMAEKHAYLDTIRVDRLAFLKTNV

SEQ ID NO: 8900 - protein, 21 aa, synthetic construct
KLKLLRRLLKRFHPTHDTCML

SEQ ID NO: 8901 - protein, 29 aa, synthetic construct
YLRLMKKWFKKIHKAKFLAFIHLDAVLLD

SEQ ID NO: 8902 - protein, 82 aa, synthetic construct
RLKLLRKFWKKLCKAERFAGAVAKKSTSLKNIARLATARWWRRSQIKSRIFKAAKKANECWFRYSAAYQILEKRKLPPLFKV

SEQ ID NO: 8903 - protein, 33 aa, synthetic construct
LMKLFKKLFRRMQKRDRGSLLCLMAKAAETALK

SEQ ID NO: 8904 - protein, 49 aa, synthetic construct
RLKLMRKWIKKLRKARTAAFLLLWCRFEALPPYKYHRYPDKLKKYRLLF

SEQ ID NO: 8905 - protein, 34 aa, synthetic construct
KLKLLTRLIRLLRRLKARWQARILFAKKAVLGML

SEQ ID NO: 8906 - protein, 33 aa, synthetic construct
LFKLIKKLFRFLQKVYKAAAGKNYYKRRQVLNA

SEQ ID NO: 8907 - protein, 33 aa, synthetic construct
LFRLWCKMLRKLHKALNLRAKWMGYTACKKIML

SEQ ID NO: 8908 - protein, 64 aa, synthetic construct
RLKIFSKLLRMFKKDRRLENLQKMLRWARLRKEVGLRKIAPACMAARAMRTAKKQLCRDLACTT

SEQ ID NO: 8909 - protein, 21 aa, synthetic construct
RWRWFRRLLRRMKTLALKVAG

SEQ ID NO: 8910 - protein, 47 aa, synthetic construct
RLRLWRKFFKFMRRLILRPKKFMRSAALKLGEPRQRQIQLAMLKTHH

SEQ ID NO: 8911 - protein, 83 aa, synthetic construct
KLKLFKRFLRRWRKFMGGKRKANAMIDMIMRLLLLPWRRWAVRKPPKERNRWKLKELAQKKLWLRALHLAGLRHAWPCLHKYT

SEQ ID NO: 8912 - protein, 40 aa, synthetic construct
LFKLLKKWLKYLRCMLCREAKFLAAPRNDLARWAGTNSQW

SEQ ID NO: 8913 - protein, 23 aa, synthetic construct
LMRLLQRILKRMKKAVIRTHRLL

SEQ ID NO: 8914 - protein, 45 aa, synthetic construct
RLRFFCRLLKKFTKGAAMNTLNKHKLNEFCGRSLLKIKAWAAQKR

SEQ ID NO: 8915 - protein, 23 aa, synthetic construct
WLKFLRKWWRILRRWLLTARHNK

SEQ ID NO: 8916 - protein, 51 aa, synthetic construct
RFKLFPRLLRKFKRKRCRALLAMIGRPCKAGLPAAPQHKDVHRTLLRLQII

SEQ ID NO: 8917 - protein, 28 aa, synthetic construct
RLKFFCRFLRRWRRLEHKHLLLIATTAK

SEQ ID NO: 8918 - protein, 80 aa, synthetic construct
KLKLFKKIMKRLCTRILTRAGPARVEAYNMALLRKWKNPVFVWRRDDLKRRKHDFLLLAYASKDAHKLLNAAYYHRLCRQ

SEQ ID NO: 8919 - protein, 35 aa, synthetic construct
YLRLLCRILKFLRSIWNKMGAVRRLRLRKKAARLQ

SEQ ID NO: 8920 - protein, 86 aa, synthetic construct
LFKYLRRLWRMYRRADKLRMCLKLQMNKKLKNGAWRKKCLNQMAPLIAAERHALRIKFFRAKRWLTSWRAAAKVRMIMCFRAGMSR

SEQ ID NO: 8921 - protein, 30 aa, synthetic construct
RLKFMPRLFKFLQTARCKALLNRIRLLTLF

SEQ ID NO: 8922 - protein, 24 aa, synthetic construct
KLRLFTRLFRRFPRFWLDDAIKAK

SEQ ID NO: 8923 - protein, 40 aa, synthetic construct
MIKFLHRLLRLFRRHKAKKADWSYKRAAYQCLALRALYAF

SEQ ID NO: 8924 - protein, 49 aa, synthetic construct
YLRMISKLIRLLNQKEKKLLARIRAKLLRLRRGKKQSLQLKAVLVDSAG

SEQ ID NO: 8925 - protein, 66 aa, synthetic construct
KMKLFKKLMKKLKKKVKDAKAKQVLNLASLWKLRQRHEAADSAAKWEKLHLFSFRSASCPRPKNNT

SEQ ID NO: 8926 - protein, 41 aa, synthetic construct
WLKLMKRLYRRMKKLMWMPQRAKKDAKEYILKRSGNLLSLN

SEQ ID NO: 8927 - protein, 41 aa, synthetic construct
KLKLIKRLYKKIRRAGAQAVPWAELTWLLELCHLAFFKMCK

SEQ ID NO: 8928 - protein, 37 aa, synthetic construct
RLKWLSRLMRKLRRRALSRAVLSCDAAWVWLHRPRHY

SEQ ID NO: 8929 - protein, 35 aa, synthetic construct
LWKWWNKLLKKFKCNILKLLLQYATKEFIRILRRK

SEQ ID NO: 8930 - protein, 42 aa, synthetic construct
RLRFIPKLLRILRQLGIKALKAEKTRRRDAKAGAGYWPLAKR

SEQ ID NO: 8931 - protein, 59 aa, synthetic construct
RLKFLRRFLKIFSCVCKNTKGAKKYNDLLARVAARNLRLVNKYKRRDRISLGPALKDIA

SEQ ID NO: 8932 - protein, 27 aa, synthetic construct
LLRWFRKIIRYLRPARKSELCKLALLK

SEQ ID NO: 8933 - protein, 35 aa, synthetic construct
RMKYLKRLYKFIRNPRKDYILRILESLNRALANLA

SEQ ID NO: 8934 - protein, 43 aa, synthetic construct
YLRWLQKLLRFIKRFRMAKYRRKYLTLGACNFPCTAKLRWLKW

SEQ ID NO: 8935 - protein, 25 aa, synthetic construct
LFRWLRRFLKRLRSALQPFRREKLA

SEQ ID NO: 8936 - protein, 40 aa, synthetic construct
FLRLWKRYWRFWKKSACRLARHLNLRAHRQLLALSAHQWN

SEQ ID NO: 8937 - protein, 27 aa, synthetic construct
RYKYYRKFLRLYKHYRAAAQLSVNYAA

SEQ ID NO: 8938 - protein, 21 aa, synthetic construct
LWRMMHRILRIWRKAPAARRE

SEQ ID NO: 8939 - protein, 43 aa, synthetic construct
KLRIFKKWWRYFRKISLVWKKARSEFQRARLCLAVLDKLYCLL

SEQ ID NO: 8940 - protein, 56 aa, synthetic construct
KFRIFRRYLRKYRKRAQPAIAMHGKCKLLCLARRDEFHMELYRAHLRAAWACLLLS

SEQ ID NO: 8941 - protein, 40 aa, synthetic construct
YFRLYKKFMKWIKSLCKLALRLQCRQALAAGAARLKKGLM

SEQ ID NO: 8942 - protein, 38 aa, synthetic construct
RLKFLKKLLKIFHKLEAGKAKRMKSCRCLLARAKAKEV

SEQ ID NO: 8943 - protein, 90 aa, synthetic construct
KLRIFSKLFKFLHRAAREDTLLACHKFCAYALTYLNAGRWLRRAYLRVLGGRVATGRKKHAKVRAYRYKKLFRAKLRVAFMFNQARRVWC

SEQ ID NO: 8944 - protein, 46 aa, synthetic construct
LIRWIKKLLKFWKNDPWAAWLAKAKAKRLAYGHTLDGFRARKLQSP

SEQ ID NO: 8945 - protein, 94 aa, synthetic construct
RYKFLHKMYRKLKQHLIAWGLARCLPNRIRIMLVLRQRYAPLWFLMKLARKRAKNFAALRRTYAAAWRNRHYMLRAVRQEMDQLARNKARKKTT

SEQ ID NO: 8946 - protein, 24 aa, synthetic construct
LLKLISRLMKRFTNGSLVRANRRR

SEQ ID NO: 8947 - protein, 73 aa, synthetic construct
RMRLLQRLLKRFSRLACEALVKKRKKAGYIYLRLSTLRFRALLPKKRWNSEYLKRKSNKSAQANKSKNLARML

SEQ ID NO: 8948 - protein, 27 aa, synthetic construct
MWRLWRKLFKRFCPCLKLKLRASAVAE

SEQ ID NO: 8949 - protein, 23 aa, synthetic construct
KLKLLPKFFKLYTKFLRYGKAQP

SEQ ID NO: 8950 - protein, 54 aa, synthetic construct
KFRFLCRLMKLFKKLQLRKGLRAQCALLLRADDNENLRKYRRNFKWKPTMYCLV

SEQ ID NO: 8951 - protein, 40 aa, synthetic construct
LFKLWSRFYKFFNKDRPKAALRAFSLWWRWTARKAKLCLL

SEQ ID NO: 8952 - protein, 39 aa, synthetic construct
LMKWWRKLWRRLSCVCAGAKKALMPTAIGARKAKRKRKL

SEQ ID NO: 8953 - protein, 33 aa, synthetic construct
KYRWLRRLFRLLRSFCKYHLRRMARVAQEFFLK

SEQ ID NO: 8954 - protein, 45 aa, synthetic construct
RIRLFKKLLKFLRHLGNLRTHAAWIWASMKEHWKELLLIRNLRRK

SEQ ID NO: 8955 - protein, 28 aa, synthetic construct
KIKLLRRFWRWLKRNNARLMQALAKPRW

SEQ ID NO: 8956 - protein, 42 aa, synthetic construct
FIRLWKKFIKKLKSYLKLDLLRVRELRYSKLFMAKKLQYWNR

SEQ ID NO: 8957 - protein, 53 aa, synthetic construct
FMKMWKRFMRLMKKHPKAFRKGRRFRAYRKLLALAADANLCLLHFLPYIAQAA

SEQ ID NO: 8958 - protein, 20 aa, synthetic construct
KMRFWKRYLRRLTKLYQPAA

SEQ ID NO: 8959 - protein, 23 aa, synthetic construct
LLRMLRKLLRFYRSAWRLAHTWD

SEQ ID NO: 8960 - protein, 42 aa, synthetic construct
LLKLFKRYMRKLHRVRMRGKACGKAHRIQAKRAWAWCLEYRL

SEQ ID NO: 8961 - protein, 27 aa, synthetic construct
KWRFYSRILRYLQQKGAAARGLLRRLH

SEQ ID NO: 8962 - protein, 23 aa, synthetic construct
KYRWLPRFFRLFNKAADASLKAQ

SEQ ID NO: 8963 - protein, 37 aa, synthetic construct
FLRLWCRLFKRLCKRLAKRHLGACDWMAWTDAALKKA

SEQ ID NO: 8964 - protein, 70 aa, synthetic construct
KYRIWCKLIRRWKHWLSKFPKKVIARFCYAAAPRRLTCKLKKVRMLRMILPARACATALRLQKNSLKKIR

SEQ ID NO: 8965 - protein, 76 aa, synthetic construct
RYRILKRFLRRWRTDYHSRTSGRSLFYYAVQQARKANKRTRGNNVLLRLSKLAKKALLGSCLLLPANKLHRKQSRL

SEQ ID NO: 8966 - protein, 40 aa, synthetic construct
LFKFMTRFFRKWRRLKRQRCANAAADACALHHPASLLDRE

SEQ ID NO: 8967 - protein, 70 aa, synthetic construct
LLKLLTKFWKRYRKTRKTGYATCSLRDARCAVARARINAKRRMSRKQAKGRWGFRFLVLWLAKMKMKDPY

SEQ ID NO: 8968 - protein, 66 aa, synthetic construct
KLRWLNRLWKLWKRLAQKLKLNWLQTHMKTARTYAMASNQGDARKARKAAMRLVVARQLMWKESLS

SEQ ID NO: 8969 - protein, 65 aa, synthetic construct
KLRLYCRLLRMLHRKFKQSWAFAAAFQGLHQGKVKNSRAKDRAWRCRKTHSFKAAAMESLRLRRK

SEQ ID NO: 8970 - protein, 20 aa, synthetic construct
RLRYFQKYWRKMKCVLAALE

SEQ ID NO: 8971 - protein, 79 aa, synthetic construct
FYRILQKLWKKMKKARWLAKEKKRLKEWLYVVHAFACEHSPRNALIAWCEKMHAVEPLRRKRLASAAKFLSLRLLLMRE

SEQ ID NO: 8972 - protein, 20 aa, synthetic construct
RFKIFTKLLRYFRPRLAAAK

SEQ ID NO: 8973 - protein, 69 aa, synthetic construct
LLKMFKRLFKLLRHRPAYAFRDREYLPRLTARGWGRFLKKDKWLARAFFKDKTLRKKDHFLTLKCKLYW

SEQ ID NO: 8974 - protein, 33 aa, synthetic construct
LFRILKKMLRRLRKRPFLKWIGLRLALKDKQLR

SEQ ID NO: 8975 - protein, 49 aa, synthetic construct
YLRWFQRFLRKLKTKPNAQILDKLRADLCRDAWVGRLKALKTVGKRLLH

SEQ ID NO: 8976 - protein, 26 aa, synthetic construct
RLRLLSRLLRRFCPHCRYKWLAAFRA

SEQ ID NO: 8977 - protein, 35 aa, synthetic construct
KYKLMKRFFRFLRQRTWADLHKLAKDPTLKLYKAL

SEQ ID NO: 8978 - protein, 25 aa, synthetic construct
KLRWYKKLWKYWKQLRKQHELCALF

SEQ ID NO: 8979 - protein, 23 aa, synthetic construct
ILRWFSKLFRLMHRALKPTTKLR

SEQ ID NO: 8980 - protein, 79 aa, synthetic construct
RFKIFRRWLRKFRKLAHLKELANHLNKYAIWLEITMSVGKKKRKPSCNALPLDRRLTLLRAAYMRDLWREALDLAEAKP

SEQ ID NO: 8981 - protein, 33 aa, synthetic construct
LYRLLKKYIRFLKRLKVLMLCRLWVLYRKLDHT

SEQ ID NO: 8982 - protein, 26 aa, synthetic construct
RLRLWHRLYRKLKHIKGALMAELWTR

SEQ ID NO: 8983 - protein, 36 aa, synthetic construct
FLRILRRMIRKFRREAWCPLRKARRTVLQRQLALWL

SEQ ID NO: 8984 - protein, 67 aa, synthetic construct
WLRYLKRLWRLYRNLKNVKRSIPLVWWKSCARLTSAAGRRLLRKICLFDLRDKKERSIKAATEKAAF

SEQ ID NO: 8985 - protein, 50 aa, synthetic construct
KIRLFKRLWRKLCKGALGALKWNEEKDLERKRAALDKMVAAFGRKWLRPF

SEQ ID NO: 8986 - protein, 20 aa, synthetic construct
FIRLLRRLFKLLSRLLRDRP

SEQ ID NO: 8987 - protein, 86 aa, synthetic construct
KLKLWKRYLRRFKRLLKAAKNRPRAHKQNLYLKHKAWVRTSKHLRAHEAVPWARLQKRLFCCVFNPRLIRVAMYHREALKIKMEAS

SEQ ID NO: 8988 - protein, 41 aa, synthetic construct
LLRMMPRLWKRLPRRMFLNPWQRAQKFAIKHAKKLRKKLAA

SEQ ID NO: 8989 - protein, 41 aa, synthetic construct
KIRLFKRWFRLIRSFCGLFLGGALNTAKLAKEKRFVGALKA

SEQ ID NO: 8990 - protein, 50 aa, synthetic construct
KMKLLNRLFRRLKRYCKEMNIAKSQMLFCLKAASVWALGARRAARDRRGM

SEQ ID NO: 8991 - protein, 80 aa, synthetic construct
KWKLFHRYYKKMCNMVYARKKKHLLLPAPELQPSRVGVKAMALKCTSLLEYASKVRKHAARAPRAARCRAWANKGLARLA

SEQ ID NO: 8992 - protein, 71 aa, synthetic construct
WFRWIPRLFRFFSKIRRLPLEPIRSKLALKKNAAWIKLSLAKNLSLRPKKRRARGCGSKNEHLTRKAAKAL

SEQ ID NO: 8993 - protein, 43 aa, synthetic construct
MMRLLKRLFRYWKPKIILEAEKNLRARRAKLWALALPKARFKL

SEQ ID NO: 8994 - protein, 83 aa, synthetic construct
KWKLYKKLMRRLTPAMPDLLLLMRCRAARAQKNRAADWAAECSGIRAAPEFWDIKERLRRRKNATQRAKAYDYKKIRCRSKRH

SEQ ID NO: 8995 - protein, 76 aa, synthetic construct
KWRWIRKLYKLLKSIRTLLRAMLFKLIIRILHLETHKMLKILFYKLLMLDRWETLCILAEFPALHRDLIPLKKRKK

SEQ ID NO: 8996 - protein, 25 aa, synthetic construct
RIRWWPKLFRRLNRGFAILLFKRIA

SEQ ID NO: 8997 - protein, 26 aa, synthetic construct
LIKFLRKLMRLMKKMKAAEVIRRAQF

SEQ ID NO: 8998 - protein, 76 aa, synthetic construct
KMKFWRKWLKFFRCLRDAKPRTHFISMKKCKNHWAARVLATRGCITCRKLVLFYRLELLQHAKTKLRLARHAAKKA

SEQ ID NO: 8999 - protein, 80 aa, synthetic construct
RWKMMKRLLKILKNWLRAATHQMRGLLRNLHARRNRNKCSAANKRFPTAPLGRDAAREKPFEHLEKAKRLRDRMMLLAPF

SEQ ID NO: 9000 - protein, 34 aa, synthetic construct
KMRLMTKLLKKLTRHAPYRASAANDKRHKPEEYL

SEQ ID NO: 9001 - protein, 96 aa, synthetic construct
FWKLLKRWLKWMRKLRAGAKKLLMAYWCFKNLKLYMALKKWKLLEWAKYAIRLAKCWELLEARENEKRRPEKPFMCNGLQLLRRIKNQRTEKRWGP

SEQ ID NO: 9002 - protein, 55 aa, synthetic construct
IMRMFQRMLKRIKKAISFKAREEARALKMLLRRHDARALNAAKILCLRVKNMDRL

SEQ ID NO: 9003 - protein, 35 aa, synthetic construct
KLKFWRKLLKIYRPLYRALNRTPKQPLLGMKLLEC

SEQ ID NO: 9004 - protein, 90 aa, synthetic construct
RLRILRKLFKKFSRWSAWQLRKDKVKACARSYVDLKQLRIKAQLLKSLAQRKRPSLRWLYAWDALLYNLARWLLNYLHGDLDRRNLNGVE

SEQ ID NO: 9005 - protein, 57 aa, synthetic construct
RLKYMSKMLKIIRKPATTMARAAKRRHDTLPEKMKVNGDLLHKLRLHKMLLKLKRAL

SEQ ID NO: 9006 - protein, 29 aa, synthetic construct
RFRWFHKLYRLLKRTAIPRWAKCHQALFA

SEQ ID NO: 9007 - protein, 27 aa, synthetic construct
RLRWLCKWLKKLKTYLLLSLRSYRPLF

SEQ ID NO: 9008 - protein, 53 aa, synthetic construct
KLKYLKKFIRMWRPKIYIKAMKHKASRRLRLNSSTLWIKRLAELANFLRHALC

SEQ ID NO: 9009 - protein, 46 aa, synthetic construct
RIKMWHKFWRLIRREKPRALKDRHARLSFALAARQLRDEFYKKQLA

SEQ ID NO: 9010 - protein, 95 aa, synthetic construct
FMKLLKRLLKRIKKLACAAWIKAWHQLAICPHAVSCRLAALAGYKAVRKKNKRYKLKLALTGAMKVKACGDKRRKLLAGMYRKRRNKDRLFLKND

SEQ ID NO: 9011 - protein, 100 aa, synthetic construct
RYKWYRRMLKYMKHKCKAAKDDKAMKSAPIGAKTKEVELSVFRKLKWLCLYLIRLSKHSLAACRQAAQLRLARKRRPYNALKMRPRPRARKPNAKSGGCF

SEQ ID NO: 9012 - protein, 73 aa, synthetic construct
KYRFLRKLLKFMKRFKCRALFKHAAAALRLTTRLGGMAAMKKQLDNALEHRKFSGRALGAWLNKLDRMRFYDC

SEQ ID NO: 9013 - protein, 22 aa, synthetic construct
ILKIWQRILRRLKKMLQAAPPA

SEQ ID NO: 9014 - protein, 49 aa, synthetic construct
IIKFFRKFLRIFKKRRCQAIAAQRLPAAWLHKAKQLKDRLTMLLRTWDC

SEQ ID NO: 9015 - protein, 20 aa, synthetic construct
RLKLFPRILKKWKRYWLAQF

SEQ ID NO: 9016 - protein, 37 aa, synthetic construct
KWKFLRRIWKKLKQKLLFKLCAFVCNKRKLLLYPLLK

SEQ ID NO: 9017 - protein, 61 aa, synthetic construct
MFRLWSKFFKKWKNRSWARYSRYRRKLGKCKCLMRAERLMRRAPLALERRRNLALKLKTAA

SEQ ID NO: 9018 - protein, 57 aa, synthetic construct
RLKLFRKWLKLIHRHVRRKDALLLRLLANKCVLRKGRRVFKFLPLIMMGRLTITSGD

SEQ ID NO: 9019 - protein, 44 aa, synthetic construct
RLKWLRKLLRLWSPVARNPAHTQKACLLCLTEERLCKWAAREDK

SEQ ID NO: 9020 - protein, 20 aa, synthetic construct
KIRLLPKLLRYLNHRRCQLL

SEQ ID NO: 9021 - protein, 34 aa, synthetic construct
RYRYICKLIKRLPRYAALTGLILKSVMKRPRVLK

SEQ ID NO: 9022 - protein, 60 aa, synthetic construct
KLRYFQRLLKWLCKVERRLGDRAGIRKTPFPIALRMAMPQHVRAAARTLKALHFRLWYRR

SEQ ID NO: 9023 - protein, 68 aa, synthetic construct
KWKWWNKLLRRLHCLRKRLAMAKRQAIKRDPRKMRTLTVDAAGLDLMIQILYDKKRVCRAKEKMNLRV

SEQ ID NO: 9024 - protein, 29 aa, synthetic construct
LFKLLTRLFRKFKKKAKNPVLRRDLLMVQ

SEQ ID NO: 9025 - protein, 69 aa, synthetic construct
LLRLIRKMLKKLKSVWLKIRELRLRQAQAGNRPNKLKFKPNALDVEKAIKGWSAAKLLAAAKHLWGLCT

SEQ ID NO: 9026 - protein, 58 aa, synthetic construct
KMKLLRKWLKFWPRRIAYLAVKCTAGRHWAAGCRRRQQAKRQRFITARWLALAAHRQN

SEQ ID NO: 9027 - protein, 41 aa, synthetic construct
FMKWLPRLMRRLRKKKKGNVALRRKVMGLNEHLKACANLAC

SEQ ID NO: 9028 - protein, 21 aa, synthetic construct
LIKYLRRLYKRFQQQQERLRL

SEQ ID NO: 9029 - protein, 24 aa, synthetic construct
RWRLIKKMMRRLQKLAWHACAANL

SEQ ID NO: 9030 - protein, 45 aa, synthetic construct
YFKLMRRLLRRMCKREERFGSALCWAAFPMHALDRALGQKRRLML

SEQ ID NO: 9031 - protein, 22 aa, synthetic construct
RMRFLKKFIKKLRTKLSLALLA

SEQ ID NO: 9032 - protein, 25 aa, synthetic construct
WMRLLRKLYKLFQRHKAHRPAARPW

SEQ ID NO: 9033 - protein, 46 aa, synthetic construct
KLRWLSRLLRYYSNRMVAFARRALAPLLPTKNLWVIRHALKRPLKC

SEQ ID NO: 9034 - protein, 40 aa, synthetic construct
KLKLLRKFLKLLRKGSFQPGIDWGAEGLRMFASGKARAIA

SEQ ID NO: 9035 - protein, 70 aa, synthetic construct
RIRFFRRLMKRFKRKYANFAALAIKKRTAPKPNRWKRAKICRALCLLCKMTYIARLLLVRLRREALFIHG

SEQ ID NO: 9036 - protein, 52 aa, synthetic construct
RFKWLSKYLKRIQSYLDRKDAKTLQKCAKLLRSLYDKKQAKFKVCAKLIASG

SEQ ID NO: 9037 - protein, 35 aa, synthetic construct
RLKFLKKFWKLLKKNEASKVEKVRTKMRAALHLLE

SEQ ID NO: 9038 - protein, 30 aa, synthetic construct
RMRLFKKFIRYFRNLLKLPLHQRWADLSAA

SEQ ID NO: 9039 - protein, 36 aa, synthetic construct
IIRMLTRIYKRLQHVRSAARARLRRFLAVIAAFADI

SEQ ID NO: 9040 - protein, 20 aa, synthetic construct
YFKLLTRILKRYRKACPTAS

SEQ ID NO: 9041 - protein, 27 aa, synthetic construct
KMKIYTRLFKFLKRARLKAIHAALKIM

SEQ ID NO: 9042 - protein, 33 aa, synthetic construct
LLRIWKKLFRFWRKMVKCAKFNRLRQQFRACLA

SEQ ID NO: 9043 - protein, 86 aa, synthetic construct
LWRLWRRWYKRLTNIANAFWFSLKLAIDRKHAAKRWPILLQAALRLVMKVRKARKGHRRKDKSRSKQAAVLLKRNLVYKPKSSLFK

SEQ ID NO: 9044 - protein, 28 aa, synthetic construct
LYKILKRFFKLLSKLQFKKERWMLRALV

SEQ ID NO: 9045 - protein, 60 aa, synthetic construct
KLRIYKKWLKKLTNCKEVKLLTTIMVARDGVLDAALFKACIDRHKKNGALRKKCCLKLLC

SEQ ID NO: 9046 - protein, 42 aa, synthetic construct
LLKWWKKLFRRIKKKIEVIPANRIARALKICCARGKYLKYSL

SEQ ID NO: 9047 - protein, 26 aa, synthetic construct
KFKLIRKILRFLHRAARFRFLNGAEA

SEQ ID NO: 9048 - protein, 48 aa, synthetic construct
RLRFICRWLRLYKKTWRKLLKRQAEAPALCCSRTHAARRLTKGKKVRA

SEQ ID NO: 9049 - protein, 34 aa, synthetic construct
WFKYYRKLLRKFTRTLLSARRRRDLGVKYANLAK

SEQ ID NO: 9050 - protein, 38 aa, synthetic construct
RFRFLCKLLKRWHSAQVRLDWKIIITAAARARLHKRLP

SEQ ID NO: 9051 - protein, 32 aa, synthetic construct
RLRFFQRYWRKLTRSLCDHHTAEKKLANAKLL

SEQ ID NO: 9052 - protein, 61 aa, synthetic construct
FMRFFHRILKILRRAAKMAAGTLQLRKKSNKEYTLGNAAIELRRRLAADKSLSTTLGLLKK

SEQ ID NO: 9053 - protein, 45 aa, synthetic construct
RLRWLRRFYRFIRRHGRAAMHKACLKRLWARILRLMAAAATARMA

SEQ ID NO: 9054 - protein, 81 aa, synthetic construct
YLRFLQKWMKLLSQQKRPIPVALKMMKFERKAGALSANLLAKRKFKKHAVYKKNKALPPLKHKRRLRALKKAKFTRFWDYL

SEQ ID NO: 9055 - protein, 38 aa, synthetic construct
FFRIFKRFLKLMRRLLLRAPDAAKNYKYWRKLYFTLRW

SEQ ID NO: 9056 - protein, 78 aa, synthetic construct
LLRLYTKYLRLFKRAKLKMADLRYPILEDYNRYRTMWKRALRKGSLDDMFRFTAKALKKQLWNVIVFIARALKRLYSK

SEQ ID NO: 9057 - protein, 22 aa, synthetic construct
MLRLWKKLLRLYRKHNLASRRI

SEQ ID NO: 9058 - protein, 29 aa, synthetic construct
FFKLLRRFLRRLKRILFDKLRWEAAALYA

SEQ ID NO: 9059 - protein, 26 aa, synthetic construct
RLRLYSKLLRLMRQASKDETHGLKLW

SEQ ID NO: 9060 - protein, 43 aa, synthetic construct
WIRWLRKMFKWLKKRRAQVRNDRAKALIMMLRAKVRADAAMNC

SEQ ID NO: 9061 - protein, 21 aa, synthetic construct
KLRFISRLLRRMKTILANQTR

SEQ ID NO: 9062 - protein, 32 aa, synthetic construct
FLRYFRRLLRKLHRTTLTQAACAKHIRPKKVT

SEQ ID NO: 9063 - protein, 24 aa, synthetic construct
YYKLMKKFLRRFCKQANKYAPKLL

SEQ ID NO: 9064 - protein, 31 aa, synthetic construct
LMRLWRRFLKKFSKRLRSRALKTLDRLSHED

SEQ ID NO: 9065 - protein, 34 aa, synthetic construct
RIRLIKRFIRLFRKDCAARAPRLRSILKASLRFG

SEQ ID NO: 9066 - protein, 30 aa, synthetic construct
RLKFIRKILRYLRHAMHLAFGLARMKARII

SEQ ID NO: 9067 - protein, 34 aa, synthetic construct
KMRIWSRIMRKLQRCQDMKKDKAAARLIMLLPAR

SEQ ID NO: 9068 - protein, 30 aa, synthetic construct
WYKLLRRMIRRFTKKAEKAKTQLPLSETKA

SEQ ID NO: 9069 - protein, 46 aa, synthetic construct
KYKFYPRLLRYMRHLRCLNGLLKVDLIAAYKKEPRFDLARSACLAK

SEQ ID NO: 9070 - protein, 43 aa, synthetic construct
RLRMLSKYMRLFTRLQLRRALQRCRAKHQLGGLNPSAGLKKEG

SEQ ID NO: 9071 - protein, 76 aa, synthetic construct
FMRYLQKLFKLICSCDVLARRLVGRKRQRNKVAKSEKAWALAKLIPASHNKLMLAAKDDKKKLHIFEKKSLLCRKL

SEQ ID NO: 9072 - protein, 26 aa, synthetic construct
RWKIICKLFKIWKRKRGQLALLAAQF

SEQ ID NO: 9073 - protein, 32 aa, synthetic construct
RLKILKKFLKKFTRLHASMLKGLGKCTRLGKI

SEQ ID NO: 9074 - protein, 49 aa, synthetic construct
KLKYFKRYLRLISTYGAAAGKKSGKHCLFRKTAKLLLSDLQAKIRYSKC

SEQ ID NO: 9075 - protein, 35 aa, synthetic construct
KFKYLKRYYKLLKTKLLYRQGAWLAKSDLRMHHQL

SEQ ID NO: 9076 - protein, 50 aa, synthetic construct
RLRLWRKLLRLLNPKKHLMPLTYWLQQAHLHLWAYNSMKKHKGKLLRRHD

SEQ ID NO: 9077 - protein, 39 aa, synthetic construct
ILKMWRKILRFLKHALKALDRWAARCKKISKFRGFKANI

SEQ ID NO: 9078 - protein, 96 aa, synthetic construct
RFKMLRKYLRKYRRWLRARRLGGERVKLWAHAKALRNPKMKLKQERNRAVNENAKLKSNAGLEVHSKLLWAINAAKHLQELAKKCEAAGAWKELRA

SEQ ID NO: 9079 - protein, 84 aa, synthetic construct
RLRWWKRMMKRLHQMWRLVAHRFQRTRSAKAKLHADARYLRDKNARKAKADPRKTAQRGELAKVMLQIITALKWLKALQWKSMH

SEQ ID NO: 9080 - protein, 61 aa, synthetic construct
RWKLLKRYLRRFPRAKKELRATVMLGKKTAVKQKLTRRSLGLKAIELRLGQAPRIALKKQS

SEQ ID NO: 9081 - protein, 33 aa, synthetic construct
MLRLIRRYFKRITKKNEMALKKALQRSFLKATA

SEQ ID NO: 9082 - protein, 79 aa, synthetic construct
KWKFLKRILRKIRNLFPRASSKRDNWRGTAQWRLFYAGHKAGKRRVVALATARLRKLEWILRPPRAIRDASGAGLKLRQ

SEQ ID NO: 9083 - protein, 45 aa, synthetic construct
RYKIYKRLLKRFRNCAMKLAGFEAKMVRCFTLKLIAKKAISAAVF

SEQ ID NO: 9084 - protein, 52 aa, synthetic construct
KIRWMPKMYKFYRKALELRAKAPRRFTLAKMIKRILQKISLLLPTKMKSELK

SEQ ID NO: 9085 - protein, 57 aa, synthetic construct
RLKLFPKFIKKLSRRIRLRAAGLNVLKPYLKRLLLLRRTIKALHKNSMQKLKLLRRA

SEQ ID NO: 9086 - protein, 58 aa, synthetic construct
RLRLWKKLMKMLTRDRKATMIRPFKVLKSGKVGANKWDYSLLKERPKLLLINRAIGLA

SEQ ID NO: 9087 - protein, 76 aa, synthetic construct
RLKLMRKLFRLYCRAHWTREFFLLRAHRMVFAAKLFRSDIQFRSHDRRHKRRRLARRALAEAGLDSLRAWVLLPLF

SEQ ID NO: 9088 - protein, 63 aa, synthetic construct
LLKMLRKFLRMLTNLKGGIPAQCTELKRRLRLLDHNRLVAARHRATKAEARKVPGAYLARKGC

SEQ ID NO: 9089 - protein, 47 aa, synthetic construct
KIRLLPKWFRFYCKKEAAANANLAKKEHMLRRTLMWGLYLTRRKKQL

SEQ ID NO: 9090 - protein, 45 aa, synthetic construct
KLRMWQKWLKLLPKLPARLKKAKKEPMKTAAMEQPAHYKVCLDRP

SEQ ID NO: 9091 - protein, 39 aa, synthetic construct
RLKLLKRFLRYYTKCACHRLAELLLWKKIMRKASMKGRG

SEQ ID NO: 9092 - protein, 40 aa, synthetic construct
RYKWFRRLLKKFQKAWAANKYEFIKLALARRCGHLKFTAW

SEQ ID NO: 9093 - protein, 28 aa, synthetic construct
KIKMLKKLLKLLQKTCEPLKDRALGKFC

SEQ ID NO: 9094 - protein, 38 aa, synthetic construct
LFKYLRKYYRLFKRRLTACRVLTWPRALKCQKELDWKD

SEQ ID NO: 9095 - protein, 64 aa, synthetic construct
LIRYWRRLWKLLKKLLLKLKHPRDKQYKLSLLTKQRHKFLWCGCMRSKYDARRRCHFDAAKKAN

SEQ ID NO: 9096 - protein, 23 aa, synthetic construct
KYRLLHKMYRRWKRFAFCLTKAA

SEQ ID NO: 9097 - protein, 40 aa, synthetic construct
KIRLLQRLFRWFKKRHWAILKAKSAFSAKLSFRWRQCYSL

SEQ ID NO: 9098 - protein, 30 aa, synthetic construct
LYKLLKRFLRFYCKLVNHAQALAGLVRRFR

SEQ ID NO: 9099 - protein, 38 aa, synthetic construct
KLRFFKKLFRMIRKRNMKAPELVKCHAQRKAAGAMCLE

SEQ ID NO: 9100 - protein, 43 aa, synthetic construct
KFRLFKRLLRKWRRVWLRHNCLAAVKRSKILPFLLQERCNYCR

SEQ ID NO: 9101 - protein, 35 aa, synthetic construct
MLKWFPKWLRKLHRNRAEATAKQQAIHGELAKLLR

SEQ ID NO: 9102 - protein, 27 aa, synthetic construct
RFRLLRKWFRFWRTLIAAKAAQKAMEG

SEQ ID NO: 9103 - protein, 40 aa, synthetic construct
RYKFYRRLLRKFKQWQAYKLLALRTKAFNKRPASDVSWAL

SEQ ID NO: 9104 - protein, 42 aa, synthetic construct
YLKILHRLFRMIKHKRKRLNKKLFKLRRPQILLRMAAYKWLL

SEQ ID NO: 9105 - protein, 22 aa, synthetic construct
LFRLFQRWFRKLRSLCAKKAHD

SEQ ID NO: 9106 - protein, 62 aa, synthetic construct
KYKILRRIYKKLKSADLGRVKKHSLFRDLQQRLQAKPRQRVAWPHLLRSKIAHFARRARNFA

SEQ ID NO: 9107 - protein, 61 aa, synthetic construct
FLKLLRRLFKKLKTAIAPRRDLAACRDLKEEWRRASVRVWKQMRTQYLLQKRHRKAGQMLT

SEQ ID NO: 9108 - protein, 64 aa, synthetic construct
RYRMLNRFIRLLQRLDVAFKRLPLPTLSLAELSKKTIYQKKRLRALKLARKAFDYKEGAFSMNL

SEQ ID NO: 9109 - protein, 75 aa, synthetic construct
KLKLLKKFIRRLRKPDERDLQAANNLQFLIPRAKFSGRLFAQQKALRGYALRMAARAPNQPKKRLRRKALAKWIN

SEQ ID NO: 9110 - protein, 67 aa, synthetic construct
FYRLLRKLYRKFCRAKAKYQIVISERRRLLKYRMRMRRPALWTRHWHKLLQNPRALTAYAKYAAGAA

SEQ ID NO: 9111 - protein, 34 aa, synthetic construct
KFRWLKRFFKKMRRLQLGQSNLRARIYLFDARAN

SEQ ID NO: 9112 - protein, 44 aa, synthetic construct
LLRLLKRMIKLWQSRGWHAHRMGAKTQLMRANKARRYLAAEKQM

SEQ ID NO: 9113 - protein, 29 aa, synthetic construct
KFRFLNRIIKLLCKGFKHCLRRILRFLAT

SEQ ID NO: 9114 - protein, 61 aa, synthetic construct
MLKLLRKLLRWLRSHAAPHRYPNQRKRLLWLCFKGVMFAEVKYKRSMKLLHLHKAKNYWAR

SEQ ID NO: 9115 - protein, 20 aa, synthetic construct
FFKYLQRLIRLFKRYAYQLA

SEQ ID NO: 9116 - protein, 73 aa, synthetic construct
RLRLMKRILRRYKQKMLRACANQLAGAMSAAAALAKGADEQLKRKRLARKWASVICFQLAKKVDMINKHLLKD

SEQ ID NO: 9117 - protein, 20 aa, synthetic construct
KLKIFRKLLRLLHCVWGQFA

SEQ ID NO: 9118 - protein, 34 aa, synthetic construct
KYRFIKRMLRRFRKIAAECDALNNLRLRVQKLLE

SEQ ID NO: 9119 - protein, 64 aa, synthetic construct
KMRFFRKMFKIMKKAKPWYWLLKAKAAKDKNARMAIAKRLACLMNEARDECAWDTKRVKATPLA

SEQ ID NO: 9120 - protein, 44 aa, synthetic construct
KLRLFRKMMKKLHRYAETLAARKMLLLKRPLRLKVENLRDAWAY

SEQ ID NO: 9121 - protein, 85 aa, synthetic construct
KLKIFRRFLKRWKCLVLMLAWKQLLKLRKAMNLHLRGKDQDAVFANHDCSKAARIRKPAHQWSLSKRALAAIPMLKACRNQSARS

SEQ ID NO: 9122 - protein, 27 aa, synthetic construct
YFRLFHRWYKLLKRISGLARKMAGPRA

SEQ ID NO: 9123 - protein, 28 aa, synthetic construct
RLKLMKKLIRRMNQNALRRRIWFAWQAE

SEQ ID NO: 9124 - protein, 47 aa, synthetic construct
LLRMLKKLLKWFRQQMAKKLCLRFKAHPKLRRLRIWYLYIVMMLLTP

SEQ ID NO: 9125 - protein, 22 aa, synthetic construct
LMRWFRRLLRILRTNFPDAKAA

SEQ ID NO: 9126 - protein, 21 aa, synthetic construct
LMKFLRRFIRFLNRARLERCS

SEQ ID NO: 9127 - protein, 33 aa, synthetic construct
RFRFWKRIWKLLHHKLLKYNYPLKKLPLARRLK

SEQ ID NO: 9128 - protein, 95 aa, synthetic construct
RWKFYKRMWKMIRKLKQCCWLKYMFRAAARCRRIKARMKPLNQLRRARAQLKQLHAAHQRFAKLLMAHLPAMARYAAAKLKRAGRIYKWWNTPKL

SEQ ID NO: 9129 - protein, 42 aa, synthetic construct
KYRFLRRLIKMWCRVKWDLRAIAKMGYYQLKLMRAKSAARVK

SEQ ID NO: 9130 - protein, 30 aa, synthetic construct
LLRMMRKFIRRWSKTLAKEHKQRAKSMAQA

SEQ ID NO: 9131 - protein, 36 aa, synthetic construct
KWRFLKKWIKRFSSKLERLITLSLARDAMQQARKLP

SEQ ID NO: 9132 - protein, 53 aa, synthetic construct
KMKLFRRLLRLYPSANYPGWHRALLAWMCKGAMLWKWRKASKLAKREADAGRD

SEQ ID NO: 9133 - protein, 28 aa, synthetic construct
YWKMIKKWLRLLKNAAWATRLEKLVLYK

SEQ ID NO: 9134 - protein, 33 aa, synthetic construct
LYKWLRRLLRRLKPHRPKWALDKTKLMGALRPG

SEQ ID NO: 9135 - protein, 25 aa, synthetic construct
RFKLMSKLYRKIRHIRALAMHKIWA

SEQ ID NO: 9136 - protein, 34 aa, synthetic construct
WYRLIKRLMRKFRKDNRKTLLSYLRAHCYSLMAK

SEQ ID NO: 9137 - protein, 45 aa, synthetic construct
KLKFWRRFFRKLQPMLIYLRAALILECKILTRKPQLLRGQADARH

SEQ ID NO: 9138 - protein, 24 aa, synthetic construct
LFKLFKRYMKRWSRAQWLEAKLAV

SEQ ID NO: 9139 - protein, 71 aa, synthetic construct
KLKMISRLWRKWQKAAPKVRSANLDLYTAVRCCAKLKRPYLHAKHLRLRAPAIFKDTDLARTTVMAKKLRH

SEQ ID NO: 9140 - protein, 29 aa, synthetic construct
KLRLLNRFFKLMNPSLMRNLRLCILFRDR

SEQ ID NO: 9141 - protein, 50 aa, synthetic construct
FLKMLKRYWKKLRRRARRNLVVEPARIRKHRERNGKALRFILLDAFREAL

SEQ ID NO: 9142 - protein, 56 aa, synthetic construct
RMRMLSRFFRKIKQEAPAKLLFLHKLLNAEVAKALKRHMVFFRIFLDLHRLGIRLK

SEQ ID NO: 9143 - protein, 85 aa, synthetic construct
WLKFLKKWYKRWRPRLARHHLALQARLLEHNRLRLARKLEKKKRVNCLLIKSLKLLLNARLSFVLEGKIRWLYRKSDYWAKCVLL

SEQ ID NO: 9144 - protein, 20 aa, synthetic construct
LLKLFNKYLRKYRKDTFLAA

SEQ ID NO: 9145 - protein, 61 aa, synthetic construct
KIKLLKRYFKYMKQAAPLRRADRKKKQWLKHNILKAFALALHTAKSLYKEQCAGHGKVCKL

SEQ ID NO: 9146 - protein, 27 aa, synthetic construct
LFKYIRRLYRMLTQRLDVATLKAKKHT

SEQ ID NO: 9147 - protein, 34 aa, synthetic construct
KWRLFRKLFKKLNKMRNVIRVAAARCIEAEWLKG

SEQ ID NO: 9148 - protein, 47 aa, synthetic construct
FWRFLRRLFKRWCTAPAIIKRMAARAASQAGVHAVKKRRPVAKYLIL

SEQ ID NO: 9149 - protein, 54 aa, synthetic construct
KYKIYTKYMKKFPQRRKLSLLALYLNRAIALLKIDRKSSTLGRRAERRSLLAIL

SEQ ID NO: 9150 - protein, 74 aa, synthetic construct
RLRLLKRLLKRYSSKLRFEMPPLLLWHDYKAAASGRMLWLVWAWARSKSWLQRGMYKFEEFLKKYLALQLRLVL

SEQ ID NO: 9151 - protein, 24 aa, synthetic construct
RFKILNKLMKKIKSISAAARKTPL

SEQ ID NO: 9152 - protein, 47 aa, synthetic construct
RIRFFTKFLRIWRRKLTLGLCAHRYKQARLTLLAKALLLWTLTWYGS

SEQ ID NO: 9153 - protein, 58 aa, synthetic construct
RLRWMRKMLRFYCKLLEKYAQNTLIHAIQKALLKRRASPKLLAKNSLTVAENATTKRF

SEQ ID NO: 9154 - protein, 90 aa, synthetic construct
RLKIFKKFYRLFSKCLKVRELKCKLNANLEKSDRAAAFKIRCPKPADIYYWDNALLRSITKRAAERMWLLWTLKKYCKQHLALLACLARL

SEQ ID NO: 9155 - protein, 34 aa, synthetic construct
KMKFLHRLFKKLPKYRMRKFPQPAQLSRAAFEKA

SEQ ID NO: 9156 - protein, 32 aa, synthetic construct
FLKLFCRYLKFWKSARRRRALVKAANHYRRAA

SEQ ID NO: 9157 - protein, 45 aa, synthetic construct
MLRLYPKLWKKFCKDLESAKCMLRPHKKKAPLALKFRGKNPRYAN

SEQ ID NO: 9158 - protein, 29 aa, synthetic construct
RLKLLRKIFKKLPNAAIRIKTMTCALRGC

SEQ ID NO: 9159 - protein, 37 aa, synthetic construct
YFRMLRRIFKWYSKRLCRYTAMKDIAMLALKKRLLGL

SEQ ID NO: 9160 - protein, 25 aa, synthetic construct
MYKLLRRWLRLLTRLAKAVSCRNLK

SEQ ID NO: 9161 - protein, 61 aa, synthetic construct
RIRMLNRLLKRLHKDQQKKLLAWELMTYRGAQALARAMRLRQGKKPRLMKFHKFRAFMKDK

SEQ ID NO: 9162 - protein, 40 aa, synthetic construct
KLRMFKKWLRILKSDKRRPIATTECCAIAAELVRKPLKML

SEQ ID NO: 9163 - protein, 70 aa, synthetic construct
RLRYFRKFMRKLRQHVLLSALFRKRPPTKEARALLMAKRKGLGLKKFKLQHRLKRRELAKECNFITVNIS

SEQ ID NO: 9164 - protein, 36 aa, synthetic construct
IMKLYHKILKKLKKWAVRNRYDQAWLKSPLRLEQLL

SEQ ID NO: 9165 - protein, 35 aa, synthetic construct
YLRYITKLLKKIRCVLAALRKIAAPAYLVRAQQRK

SEQ ID NO: 9166 - protein, 36 aa, synthetic construct
KFKWWPKLYKLLKKDKTRYAWRGLAHCVVCAEARLA

SEQ ID NO: 9167 - protein, 34 aa, synthetic construct
WFKFLRRFLRLFRRQATCHRPNRKAKMNLLARHN

SEQ ID NO: 9168 - protein, 39 aa, synthetic construct
KLRIMQRIFRFMKKLLGKLLELLAGLRATKWRQNKLGLW

SEQ ID NO: 9169 - protein, 27 aa, synthetic construct
FLRLIKRYFRKFSKLAAWNMAKRVKAC

SEQ ID NO: 9170 - protein, 33 aa, synthetic construct
RFRLMCRLFKLLKQRLSRASNLRLKKWKLKPLF

SEQ ID NO: 9171 - protein, 22 aa, synthetic construct
KYKLLRRIYRLINKKSPRGLLA

SEQ ID NO: 9172 - protein, 35 aa, synthetic construct
LFRLWKKLLRKITHVAVKKAPLHIQAALRALPRRY

SEQ ID NO: 9173 - protein, 48 aa, synthetic construct
LYRWLRRMFRLFNSCWRKKTVYLKPCRLRCAKKDLMATMPTKAKALAA

SEQ ID NO: 9174 - protein, 21 aa, synthetic construct
MFRLWRKFIKFLCKCRAKLAQ

SEQ ID NO: 9175 - protein, 42 aa, synthetic construct
FLRLFRRLLRLFKPAERRTAIETMGAKPKKRNSFLAAKWCLK

SEQ ID NO: 9176 - protein, 41 aa, synthetic construct
KLRLLPRWFKRFQKVCIARFPKMWRIMHLLLSLVLARAKEK

SEQ ID NO: 9177 - protein, 48 aa, synthetic construct
MLRFFPKFFKRFRKRDALRAFIKSAPRGRDLATAKYDHRRYKLLFMAL

SEQ ID NO: 9178 - protein, 22 aa, synthetic construct
MLKYMKRLWKIYKKDALKGIAL

SEQ ID NO: 9179 - protein, 83 aa, synthetic construct
RMKFWNRWLRKMSRVMLKAAAARRELFKQMQKDVLLKWKKMEHLKKLFKQAKMKDESYASARKYKRFWAVKMAKPDRAFALLL

SEQ ID NO: 9180 - protein, 40 aa, synthetic construct
KIKLLTRLLRKINSARGARLWYIREMSGAAKQKFLCKKRA

SEQ ID NO: 9181 - protein, 28 aa, synthetic construct
RLKMIRKLMKKYRNLLAPAILCFRRKCA

SEQ ID NO: 9182 - protein, 60 aa, synthetic construct
LFKLLSKYLRMLRHCYKLRQPWSRMKMAEKLDNKDAPMYLHLLFRLPLNRAKRLKRRKIY

SEQ ID NO: 9183 - protein, 40 aa, synthetic construct
ILRYLKKWLKIWTHKADLRRAKLWYLVRRHHARWIALSRQ

SEQ ID NO: 9184 - protein, 25 aa, synthetic construct
WLRYFRRLLKWFRKLANAYADSKFK

SEQ ID NO: 9185 - protein, 22 aa, synthetic construct
KFKLLNKLYKLLPRWILFAKFR

SEQ ID NO: 9186 - protein, 92 aa, synthetic construct
MMRYLTRLFKKWPKKLTKRKKMEVSRILLWRAARSKKKLSLLAWLRIPHAEDKDRLASCRMWKLELLRKAWEAVALTRVRKTRRQAVYLKCK

SEQ ID NO: 9187 - protein, 30 aa, synthetic construct
LFKLMQRLWKRFRKWQKLYEAAKVSLKNRA

SEQ ID NO: 9188 - protein, 28 aa, synthetic construct
KLRLMRRIWRRLKHMVPCSLALDYLMAR

SEQ ID NO: 9189 - protein, 76 aa, synthetic construct
RLKFFRKLIKLLQKLKKHHVKLEMAPYRKLKSSFFFKAEFREARAAKKEGRAKRSGGKANVTLNNFGRVALKAKQV

SEQ ID NO: 9190 - protein, 25 aa, synthetic construct
KMRLLPKYLRLWCRCDTFKRQAARY

SEQ ID NO: 9191 - protein, 60 aa, synthetic construct
LIRLIPRYFRKWRHERHFKELRLNKLRRFTLRRVFLLLILSDRYAAMLRKLCAKSRPKVW

SEQ ID NO: 9192 - protein, 39 aa, synthetic construct
RLRLYNKLIKLIRHHRRCYLCTLLVKIRAQKSEKALRLR

SEQ ID NO: 9193 - protein, 23 aa, synthetic construct
LLKLMKRWFKRFKKVAAQCEAWR

SEQ ID NO: 9194 - protein, 38 aa, synthetic construct
IYRWLKRYFRRFRNLLKQRWPLAMPAHAAHKCAKLSKG

SEQ ID NO: 9195 - protein, 29 aa, synthetic construct
FLRWIKRLLRFLPNRRLKAIARAYLLRHK

SEQ ID NO: 9196 - protein, 21 aa, synthetic construct
KMKFYSKLLKKFKHILAAARM

SEQ ID NO: 9197 - protein, 34 aa, synthetic construct
LMRLLTKLLKILKRHGDLEDILNKTAHMIRRFLR

SEQ ID NO: 9198 - protein, 35 aa, synthetic construct
MFKLMKRFWRYLKCKARRTDLRLLAKPCTADKHLY

SEQ ID NO: 9199 - protein, 74 aa, synthetic construct
YLKMIRKLIKMWKKIVMKLELLIKFKELLTARNLLLALCEREQLLLRLRKRGFLKDKVPRRHHRRQAILLQKRF

SEQ ID NO: 9200 - protein, 27 aa, synthetic construct
LWKYLQRYLKKLRKQAMQAIRKRWLNQ

SEQ ID NO: 9201 - protein, 23 aa, synthetic construct
KFRYFQRLLRRLHSGRAGWLLAE

SEQ ID NO: 9202 - protein, 61 aa, synthetic construct
RFRFYNKFLRKLKRNKCKLAATKKAEVSYGKIRLLKELFEARVHKAELSMFKALAAARDIK

SEQ ID NO: 9203 - protein, 31 aa, synthetic construct
LFRIYKRMWKIYRPNLLRLILARKLKKHLAA

SEQ ID NO: 9204 - protein, 43 aa, synthetic construct
RFKLLRRIWKRIRQKAAYGDKEARKAKKAALWHATDEPNARCL

SEQ ID NO: 9205 - protein, 43 aa, synthetic construct
RFKLLKRWIKILRCGAKADAQGRPLCEPAQRPRSLGACRLAKF

SEQ ID NO: 9206 - protein, 36 aa, synthetic construct
LMKMLRRMLRWFRNARAYQHTLLRNGLFLQKSPLKK

SEQ ID NO: 9207 - protein, 43 aa, synthetic construct
KMKLLKRLLRFLRQASKKALRPRVAKMCSFGAQKKAKNRDPHG

SEQ ID NO: 9208 - protein, 41 aa, synthetic construct
RLRILPRMLKRYRKSTKAPAKAPMRLFRLRSHCALAAMKRD

SEQ ID NO: 9209 - protein, 42 aa, synthetic construct
RYKIFKKMMRKYCSLKLALAPQAEKMLKRKARLRVAAYVPWR

SEQ ID NO: 9210 - protein, 23 aa, synthetic construct
IWRYIRKLYRKLTTALARKLMLP

SEQ ID NO: 9211 - protein, 55 aa, synthetic construct
KWKLWRRIIKFFKKKLFRKAVLCKRAKAADKLRGLMYHCASKLVFALVVRAYFKA

SEQ ID NO: 9212 - protein, 24 aa, synthetic construct
RIKMLPRMLKKWRKHLSLRWAHLM

SEQ ID NO: 9213 - protein, 76 aa, synthetic construct
RLKMLKKWLKLLRTKSKSYLLPNKWEMLPRHSAFTLKTAKLRNGCRKLARWVRYHLYLLAAPALIGIAKEKFSLKC

SEQ ID NO: 9214 - protein, 77 aa, synthetic construct
RLKYLRRLIRRWRRLRDFARARRRQLRKHALKNFCTAWWARLKRTRNAARNGILLEPLLFSKPDAKYSPQVEHWDCA

SEQ ID NO: 9215 - protein, 24 aa, synthetic construct
KLRLLNKLLRKFKSLKDEQQVLTF

SEQ ID NO: 9216 - protein, 22 aa, synthetic construct
RLRLYRRMLRYYQKGEKLLAHA

SEQ ID NO: 9217 - protein, 35 aa, synthetic construct
KLRLLQRLLKRWTKERRKYAQRARVTAWEFRTLCA

SEQ ID NO: 9218 - protein, 34 aa, synthetic construct
RLKLMKKFLRLFSTALVDSRFLKALHRAGNHKAA

SEQ ID NO: 9219 - protein, 84 aa, synthetic construct
RLRFINRLFRKFTRAAAAKIAKLWGDLNFCHHNGCRFVARKKGLKRGWLKKKAYLNKRCEAKLRKRGLRILKQTELRLLLACMA

SEQ ID NO: 9220 - protein, 38 aa, synthetic construct
RYRFMNRFLKKFQKRAMWLLKAKRIWAHHVRLTLWLEA

SEQ ID NO: 9221 - protein, 55 aa, synthetic construct
FLRLWRRLLRWMRCYARKTKLRLQDPMASQKKLGAAKLNHARALWKMKKRTQCKE

SEQ ID NO: 9222 - protein, 78 aa, synthetic construct
LLKFIKKLWRRLNNKIRRRNTMQWKSALLKSERASADFLWTLRLYIQCVMLKRRRKNAKIKQYCIRRMAALRLYLATS

SEQ ID NO: 9223 - protein, 67 aa, synthetic construct
LMRFYRRLFKRIKKLLLRLKRRKARALVKYFWESNCNFLEAAPDKLYNFKYKFTWGAKKCRLFYKAS

SEQ ID NO: 9224 - protein, 44 aa, synthetic construct
KLRLFTRILKRFKKHWKCCPLYLDLRPSSGLAAKSLLPALKKQL

SEQ ID NO: 9225 - protein, 20 aa, synthetic construct
RFRLLCKLIRKWPNLSWQRL

SEQ ID NO: 9226 - protein, 25 aa, synthetic construct
MLRLFKKYLRKWKSRAIFIKRAVAA

SEQ ID NO: 9227 - protein, 50 aa, synthetic construct
RFKFWSKILKLFRPRMLRLLKGKRKAYLAAPKPKDRAYLGARRLQKAMLY

SEQ ID NO: 9228 - protein, 31 aa, synthetic construct
RWKFIKKWYRKLRKKAANAFRRTSNCALAAL

SEQ ID NO: 9229 - protein, 67 aa, synthetic construct
FIRFLKRLWKRMKKHLELTLGALASALAKLERRYANDFTQKKHARAKLDREHAKPACIKLCMTRWLN

SEQ ID NO: 9230 - protein, 49 aa, synthetic construct
RIKILPRFLKRWCKLPRSPKKFGYAGAALADARPEALQADAEKGRLLRA

SEQ ID NO: 9231 - protein, 34 aa, synthetic construct
KFKFLRKFIKLFRTRGLRGGLKFFRFANARLTIL

SEQ ID NO: 9232 - protein, 55 aa, synthetic construct
LWRLLRRILKRWKKVKLLASKGHARLMRWKMLIACFNALLYLQRCMHRLCWYKLV

SEQ ID NO: 9233 - protein, 51 aa, synthetic construct
MYRLMPRLFKKMKRRYSGKKKAQLMAKLRLANKYLKENRTILILHYAKVLE

SEQ ID NO: 9234 - protein, 34 aa, synthetic construct
WYKFWRRLLRKLRKTAANRCAEAPAKMQFWQALH

SEQ ID NO: 9235 - protein, 71 aa, synthetic construct
FIKFIKRFLKKMSKRLLMKLRAKKLEARALRALLPKRIRKRMNPLGLCKCWTDSKIARQCKPVKVLTKHAM

SEQ ID NO: 9236 - protein, 47 aa, synthetic construct
RFRLLPRWLRRIRRPLWNAERTIARTRAAFLDACKFRKVNNLLAKEM

SEQ ID NO: 9237 - protein, 67 aa, synthetic construct
LYKYFPKWLKRLRPLLAVEFKLHGLLSLRKADMVWKRLRECERSAKKACDGRAPQRGAHRLLYYKKW

SEQ ID NO: 9238 - protein, 62 aa, synthetic construct
RMKMFQKFLKKFKQALLLPLAFNIRLEQEYLLYAPGGKLIKPVKLKLPIASKKKRRAFRKHL

SEQ ID NO: 9239 - protein, 49 aa, synthetic construct
LLRLLKKFWKKMRKKLPMLKRDARACALVKDEAVARSMGMKPSQLGAAL

SEQ ID NO: 9240 - protein, 33 aa, synthetic construct
FFKFLRRFLKFFKKLKCYLKLAKMKDRVAHELF

SEQ ID NO: 9241 - protein, 56 aa, synthetic construct
WMRWFRRLYRWYRCSSAKGAKLKLKCLPKNKLEHKRRDALCKGKARDRAKMAFALL

SEQ ID NO: 9242 - protein, 46 aa, synthetic construct
KLKMIRKIWRRLRKSKKGYLNALLNMALDYCPAPAAKRVYIRQRSR

SEQ ID NO: 9243 - protein, 38 aa, synthetic construct
LYKFLSRLFKKMCRLLARPKDMKKVRSVLGLLPWHRVA

SEQ ID NO: 9244 - protein, 72 aa, synthetic construct
RLKFFRKLLKRWRRRFVKEIYLLARWRNGAAKEYQYLLLALRRWRAFILCGLAAKTWKMDRRVWKPQIGLRT

SEQ ID NO: 9245 - protein, 25 aa, synthetic construct
KIRLLKKLLRYIKKAGAEFRGFMHC

SEQ ID NO: 9246 - protein, 33 aa, synthetic construct
ILRLFKRLYKLFTTRQLKLKTDLMWKFAKLKSW

SEQ ID NO: 9247 - protein, 37 aa, synthetic construct
FLRMLNKILKYYKRADPLRSFWEKDKAKKMCAHRLLR

SEQ ID NO: 9248 - protein, 65 aa, synthetic construct
KIKFWRKFLRWLRRSRMAARWFRSANLLRPKKAYKWVARCLAHRFLAWFSDQLFAYRAAKEADYG

SEQ ID NO: 9249 - protein, 25 aa, synthetic construct
KLKMYNKLFKKLKHLALAYANDVRR

SEQ ID NO: 9250 - protein, 26 aa, synthetic construct
FFKLLTRLIRIWTTARALLCRNRARL

SEQ ID NO: 9251 - protein, 87 aa, synthetic construct
RLKLLRRYLKIFRKALPIKLKVRRCHAKLSNQKRNSKYPTNEDKRPRRKTQHLGAAKRYVAPRSEATTFSCLRGTLVARAKATAAIR

SEQ ID NO: 9252 - protein, 22 aa, synthetic construct
KLRILHRLIKYFTRKAHYLADK

SEQ ID NO: 9253 - protein, 64 aa, synthetic construct
RLRLLNKWWRRWPNAFRWELVLAERLKADKVKHFCALRVGVWNKLKATAVWKKWRRDPRAKIRR

SEQ ID NO: 9254 - protein, 84 aa, synthetic construct
RMRIMRRIYRRYKSHCWKCSALFRAAAMWARMALRLWQHASRRLLSRALAKKALCRKKLRLRQKIRQPARIKKIPDLYWYQMMR

SEQ ID NO: 9255 - protein, 25 aa, synthetic construct
RMRYYNKLFKKYPKYALEMALRDKL

SEQ ID NO: 9256 - protein, 39 aa, synthetic construct
KLRFFRKLFKLIRKAEKNVQCLGSARLMWALALMYKMNK

SEQ ID NO: 9257 - protein, 41 aa, synthetic construct
RMKLWKRLLRRYSRRGTLRAHNMLNNLLNQAVARARLMRRH

SEQ ID NO: 9258 - protein, 24 aa, synthetic construct
KLRYWCKLMKKLSCPRLKLKAYML

SEQ ID NO: 9259 - protein, 62 aa, synthetic construct
KLRFMRRWWRRWCCERALKWRRERKVAILRRAFAIRAPLKRHKWRQSALPLRELLLRLKFLT

SEQ ID NO: 9260 - protein, 24 aa, synthetic construct
RMKMWCKYFRLLRCCLYAKSALRR

SEQ ID NO: 9261 - protein, 38 aa, synthetic construct
RMKLICRFFRKWKNLLAKKACCGRKLRYALMHSILAWI

SEQ ID NO: 9262 - protein, 24 aa, synthetic construct
LLRLLPKFMKKLKQMMNWAWRKEL

SEQ ID NO: 9263 - protein, 22 aa, synthetic construct
KLRLLHKFYKKLKRFKKILLLN

SEQ ID NO: 9264 - protein, 80 aa, synthetic construct
LLRLIKRFLRRLQRKARAAEHGLQDAAKQIKYPARLRRIRPKAQKRFIIYHKEYKLREADDKWYAFKMRLHRTAMKEHAL

SEQ ID NO: 9265 - protein, 47 aa, synthetic construct
KFKWWKKLIKKMSPAKETMAQLNQRYLWDRARAARAYAFKKRGCLGA

SEQ ID NO: 9266 - protein, 31 aa, synthetic construct
LIKLIKRFIKFLRKKQALKKHLFVALRQYYD

SEQ ID NO: 9267 - protein, 33 aa, synthetic construct
KLKLLKRILKRYRSRLKFSLKRCRAAGWQLFFT

SEQ ID NO: 9268 - protein, 20 aa, synthetic construct
KLRFYQRLIRLIHRALITRY

SEQ ID NO: 9269 - protein, 45 aa, synthetic construct
RYRIFNRLLRLWKTALKAANCDNEARKVYRCLLWWRRLQRAQLEW

SEQ ID NO: 9270 - protein, 23 aa, synthetic construct
KLKLFRKFYKKFSHAAAKRAGQD

SEQ ID NO: 9271 - protein, 59 aa, synthetic construct
FLRFLRKLMKRLKRAEHWCLLALRARARLLGARKDFPRRIKCSKVASALRYRHPVTKCD

SEQ ID NO: 9272 - protein, 60 aa, synthetic construct
KIRMYCRFLKLWRPKDCWRAKRYNLWKLLARAATAKTTAAAANDKAMMKRKRLKAPQKWN

SEQ ID NO: 9273 - protein, 23 aa, synthetic construct
RIRWLKRFLRYFTKCAKALIADR

SEQ ID NO: 9274 - protein, 65 aa, synthetic construct
RYKLWKRLFKFFNKWFWYLTLYPACIKKKRKLALVLLCKRRQGSDMAASAFLLTRHAAAYAFALQ

SEQ ID NO: 9275 - protein, 27 aa, synthetic construct
KFRLLKKMMRLIQNLPLKAKTVVNKKL

SEQ ID NO: 9276 - protein, 36 aa, synthetic construct
LFRFIPKLFRRFKSRWSCIFLARRRDALKMTALLKR

SEQ ID NO: 9277 - protein, 29 aa, synthetic construct
MLRLIRRLLRILKKYRIYYRAEFENRAYT

SEQ ID NO: 9278 - protein, 20 aa, synthetic construct
RFKMFSRLFRRLRSMLLPSA

SEQ ID NO: 9279 - protein, 44 aa, synthetic construct
FFRMWPRLFKRLRRKDKPALLAKRLEWNRRACKLGATAKPLTCN

SEQ ID NO: 9280 - protein, 88 aa, synthetic construct
RFKYLQRLIKYLTRLLRCASDARRAAKKVAKYGSADKLRQERIRRGALKLAGKAVRCTAHLDVVIKRTPLHKAKMKHSERNAWKNPRC

SEQ ID NO: 9281 - protein, 35 aa, synthetic construct
WLRWLQKFLRRYRKALKCRARGAAIPQAYTKAPWC

SEQ ID NO: 9282 - protein, 39 aa, synthetic construct
RLKMLCRYIKLWSKLREHHARPAADRKMKPLLHFRAKLL

SEQ ID NO: 9283 - protein, 21 aa, synthetic construct
YLKIITKLIKRMTKRYALLPL

SEQ ID NO: 9284 - protein, 77 aa, synthetic construct
LIRLMTKFWRLFKCRANRRIIPGRADWKTRALAQRYCRLWRVAAANAWACACLWKSGKVNRAKLLARFVRCSPAKLR

SEQ ID NO: 9285 - protein, 32 aa, synthetic construct
KFKLFRRMMRRWNKRRALALMALLSACAKEQY

SEQ ID NO: 9286 - protein, 86 aa, synthetic construct
KWRLMKRLMRWFKNPAHTAARMKKDRVSLAIYLAFCRELWMMRAALGLQAACIAIQEVDLARHTLKARLPRKRTRLGGLAAIKIAK

SEQ ID NO: 9287 - protein, 28 aa, synthetic construct
RMRFLCKMYRRFKRLWWETLLAAAHAEK

SEQ ID NO: 9288 - protein, 77 aa, synthetic construct
RLRFIPRMLKKYQKHRYKKLECAFLAWAHDLWKEERIFARNQELTLAKVSLKRAAKRIQCRKRLVWFAKRTHRMAKK

SEQ ID NO: 9289 - protein, 39 aa, synthetic construct
IMRLLKRFLKRLRRSASPCWKYVMLPFQALWADALRRSR

SEQ ID NO: 9290 - protein, 25 aa, synthetic construct
KIKLLRRYLRRWPTYNQLAGILARK

SEQ ID NO: 9291 - protein, 20 aa, synthetic construct
RIKWLPRLIKKLKKMIAQHA

SEQ ID NO: 9292 - protein, 61 aa, synthetic construct
RFKFLRKFLRLYKRWQKAHQEMKRQADDHTYKAARVSTLLKLLVCLLRARADAKNHKVVIR

SEQ ID NO: 9293 - protein, 24 aa, synthetic construct
RLRLWCKMLKKFHSALLWFNAKDK

SEQ ID NO: 9294 - protein, 30 aa, synthetic construct
ILRWWRKFYKLMRCDAFKLKTLLKIGAMLK

SEQ ID NO: 9295 - protein, 30 aa, synthetic construct
RFKLWPRLMRLLRKDGARFDLIQCLIRRFA

SEQ ID NO: 9296 - protein, 40 aa, synthetic construct
WYRLIPKLYKKYNCAKKAKLILYSLELAAKIRRLVAKWAI

SEQ ID NO: 9297 - protein, 32 aa, synthetic construct
RLKIFSKYFRKMKQSAAKLLSRPALWRAKAAF

SEQ ID NO: 9298 - protein, 58 aa, synthetic construct
LMRYIHKYMKRFKQKTQKKATVCAEARLKALPKQWRACMHLKPQKLLLVVLLARRALT

SEQ ID NO: 9299 - protein, 68 aa, synthetic construct
LMRFIQKLLRRLRKYAAAWVDKAIDLKLLVGKHYKLRKYYLIQRSGKMLQLRWKQPMAFALARFWNLA

SEQ ID NO: 9300 - protein, 88 aa, synthetic construct
KLRIFQRFFRLWKTRVKSNLIIAKINLLKKALRFLLKKAQRAWAHVLALHLRDKWLEHGKLRIAAFKALNLFNLQQKAHERDLTLTAW

SEQ ID NO: 9301 - protein, 59 aa, synthetic construct
FLKFMCKLIKKLRTLAWVKKRVWKFYKLKSPLHRHLRAERNWLALKGALAPKKRALKAY

SEQ ID NO: 9302 - protein, 40 aa, synthetic construct
KYRMIKRYLRWFSKYALARPELWQKLYAHLQAYHLAKRKL

SEQ ID NO: 9303 - protein, 57 aa, synthetic construct
RFRFFKKMIKKFKCGFRALQRGQILTLKLSKRPLARKALDALYHKSALMNAKALEEA

SEQ ID NO: 9304 - protein, 98 aa, synthetic construct
KFKLFPKLYKKMKSLHLQRARLRVARMQAKQSRKRKKWRWKNLRYRVIVLWDVRAIKTRAKRMHKKLLATDAKFRDLVMEALYRWAELFAAWAWPLAT

SEQ ID NO: 9305 - protein, 24 aa, synthetic construct
RLKFLKRFMRMLRRAQQARLKMVA

SEQ ID NO: 9306 - protein, 30 aa, synthetic construct
RFRFLSKWLRLIRCQVPLTLLTAKKYLALM

SEQ ID NO: 9307 - protein, 48 aa, synthetic construct
IWRYLHRLLKFLRTRQRRAFPALKDKLLWKAEALRSKEAKMWLRIMSI

SEQ ID NO: 9308 - protein, 37 aa, synthetic construct
WFKLFRKFYRKLKKRGQASWFLNRQLKDYLLAPRKFL

SEQ ID NO: 9309 - protein, 30 aa, synthetic construct
YLRFITRLIKKLNKSALRINEDLKRRRMLT

SEQ ID NO: 9310 - protein, 37 aa, synthetic construct
LFRILCRMLRKLPRIKKKCYAHLKLEEAALHESQAFL

SEQ ID NO: 9311 - protein, 31 aa, synthetic construct
MLKYWKRWIKLLPKTALRLSLKAAAQKWLRA

SEQ ID NO: 9312 - protein, 41 aa, synthetic construct
RLKIIRKLIKIWKRKGRACLAHRMGNARAKKPLLPKDKSAL

SEQ ID NO: 9313 - protein, 99 aa, synthetic construct
KLKLLCKMYRMFRHKLLLRALEDLEACCDTKLWKAHERLLQHRKKRRPFYKYAKRAPMLMFKLRNQRFLSDRKRLDVKQALLKRKYLAHPQEQKCIWRQ

SEQ ID NO: 9314 - protein, 69 aa, synthetic construct
KMKWFCRLIRRLRHVGKRHLLKKLQLKRLHFYGCDRFGLKWYKKKAAVAYMGRKRTGLHTTLLEYRLKL

SEQ ID NO: 9315 - protein, 38 aa, synthetic construct
KYRLFTKFWKKLPKRACDYALATYYRAALLYQLLRCKC

SEQ ID NO: 9316 - protein, 96 aa, synthetic construct
LLRLLTRWLRRFPNRYAYRTKHKIYQVIIRLSRKSKRKTIRLVYCDKEMWATDLKLKASRKSALRHPAGRALRAWLAEAALCCRRGRRVLMAAWAD

SEQ ID NO: 9317 - protein, 57 aa, synthetic construct
RIRLFKKLFRILRRRGMADLADEAAKNLRFARALHMAAFKTTKAQVVHSFAASQKNA

SEQ ID NO: 9318 - protein, 69 aa, synthetic construct
FLKWLKRFWRRFRPALWRDKWRNNHFFHAIQQNKAAKLAKAAKCYILHEKARKKCLKPEMGATKLLAAY

SEQ ID NO: 9319 - protein, 37 aa, synthetic construct
RLKFFNKLLKLWKNDILIARRKHKMMAKMSKVLFALT

SEQ ID NO: 9320 - protein, 57 aa, synthetic construct
RMKIFQRFFRRLHRILLHRARIAKGLWIELHLRAAAHLRCIIAQQAMRATRKKFARK

SEQ ID NO: 9321 - protein, 26 aa, synthetic construct
IMKYMTRFLRLLKRLFDPKVLLARSA

SEQ ID NO: 9322 - protein, 75 aa, synthetic construct
RLRWWTRLLRKFRKMHRIRFRRRLKIDLWQHYTLLLFADKLTVYDKRGANAALEMAKGWVLAKGLMLALRRLHDN

SEQ ID NO: 9323 - protein, 58 aa, synthetic construct
KMRWLTRFLKRMHRLKGGDKPHRASLARCVLRARKLVKKMLAKGKLFASKLRWSLWDK

SEQ ID NO: 9324 - protein, 40 aa, synthetic construct
KFRWLRRMMRLIHRQVLYKRLAPMMATDIYRLRLKAQKQR

SEQ ID NO: 9325 - protein, 23 aa, synthetic construct
YLKLFRKFWRRLQCKLGLALGRR

SEQ ID NO: 9326 - protein, 27 aa, synthetic construct
YLKIFPKLLRRMPRARMKTMRAMDCLL

SEQ ID NO: 9327 - protein, 40 aa, synthetic construct
LLRIFKRIIRIIQKKLEEHKGAGLLAFRKVARWIKMKKVL

SEQ ID NO: 9328 - protein, 25 aa, synthetic construct
RLKYIRRLLRIYKKATLQASLCLRM

SEQ ID NO: 9329 - protein, 29 aa, synthetic construct
KLRLLRKLLKYWRPKITFGLHATKGAKAA

SEQ ID NO: 9330 - protein, 55 aa, synthetic construct
KYKLMKRMWKLWTTARIVSRGLRRGLNWKRLKLIRKNKRELEALERLAWFVGNAL

SEQ ID NO: 9331 - protein, 28 aa, synthetic construct
RLRLFKKLLKYICRLNDKPRYNAEAANK

SEQ ID NO: 9332 - protein, 30 aa, synthetic construct
MLKFMKRLYKRLRRDAKKERVLLSLLILAF

SEQ ID NO: 9333 - protein, 29 aa, synthetic construct
RFRWLKRLWKRMCSLKGAMLDPKEAAILQ

SEQ ID NO: 9334 - protein, 58 aa, synthetic construct
RIRILNKLLKKLRQVMHMALKKARCDSKALLRQKAKVVPGAYAMACPVTKNRIANARL

SEQ ID NO: 9335 - protein, 42 aa, synthetic construct
KLKLLKKLYKIYHKRGQGLKYAASLKILKRLGLHASACKEFL

SEQ ID NO: 9336 - protein, 29 aa, synthetic construct
KIRLMSKFLRKMRCLDRLGMARACAWKQV

SEQ ID NO: 9337 - protein, 20 aa, synthetic construct
IMRLLRKFLKRFTHEKNAWA

SEQ ID NO: 9338 - protein, 21 aa, synthetic construct
RLRFLTKLLKKICCLMMNAKN

SEQ ID NO: 9339 - protein, 39 aa, synthetic construct
RMKWFRRWLRRFNKTTIAKSATKSLAAQKLQEANKALAH

SEQ ID NO: 9340 - protein, 43 aa, synthetic construct
KMRLFHKFLRKWKTILLVTSIALSIKFDKAAAAAGHFRRDAAR

SEQ ID NO: 9341 - protein, 20 aa, synthetic construct
LYRYLKKFLRRLRRQVAGMA

SEQ ID NO: 9342 - protein, 28 aa, synthetic construct
RLRIIKRLYKRLQKRLFIKYAKLLDQLW

SEQ ID NO: 9343 - protein, 43 aa, synthetic construct
RFKYFSKFLKLLQPRNWLVTAIKHPRKKRARRCARDLTAALRM

SEQ ID NO: 9344 - protein, 21 aa, synthetic construct
FLKLLHKLIKKMRHAAEVLLR

SEQ ID NO: 9345 - protein, 42 aa, synthetic construct
LLRIMRKLYRRYSCCKKARLTGKPKPQGLLKRLTALARAQYR

SEQ ID NO: 9346 - protein, 47 aa, synthetic construct
YFRLIRRMFKRWTHMQSSLKAAKLLQKKKLGNTARAKTKWLFAPFLK

SEQ ID NO: 9347 - protein, 24 aa, synthetic construct
LIKLLKRWIKLIRRRLAAKRMSLA

SEQ ID NO: 9348 - protein, 47 aa, synthetic construct
LYKMFCRWLRWLNRPTIKLRILAQCKRRRLRRQNLMCQHHAKNLKRL

SEQ ID NO: 9349 - protein, 58 aa, synthetic construct
KLKYLRRFLKYMTSAAGRRHIWGKRLCADCRSRQKVKSWCFLNAKNMAKAAALKGAKH

SEQ ID NO: 9350 - protein, 21 aa, synthetic construct
FLKLLPRFYRKLRKKLARPVW

SEQ ID NO: 9351 - protein, 41 aa, synthetic construct
KFKLYHKWLRKLKTKKKPAKGLLRQKLSRMNYMKATQLAEC

SEQ ID NO: 9352 - protein, 20 aa, synthetic construct
LMKLMRRWLKRLKNAKLKAS

SEQ ID NO: 9353 - protein, 83 aa, synthetic construct
LIKMYQRFLKKIPHKLKRAFYAAWTRKFRCAYMIAAQRYAALDRHLPPKRELPRKCKTRKKRRRENTLKRCRLYYLGEKGALW

SEQ ID NO: 9354 - protein, 43 aa, synthetic construct
KMKLMNKLLKKFSKNQRVSLHIVKTRKLLLKSLLGRKNQRLAI

SEQ ID NO: 9355 - protein, 28 aa, synthetic construct
MIKFLKRLWRKFKREKLAQLQAVASASK

SEQ ID NO: 9356 - protein, 27 aa, synthetic construct
RIKLLKRMYRLWRTLTEKMMQNRLGAA

SEQ ID NO: 9357 - protein, 49 aa, synthetic construct
RWRYFTKFLKKYRRLAKADDSHGRYLARGLRREAAQQASNKRIALKSRF

SEQ ID NO: 9358 - protein, 34 aa, synthetic construct
KIRIWKRWYRLYRTCASKGCRWAAATAGRLAALE

SEQ ID NO: 9359 - protein, 34 aa, synthetic construct
RFKLLKRLIKKFCQARPKAQWANEDLKHALVDMA

SEQ ID NO: 9360 - protein, 48 aa, synthetic construct
WWKYYKRLLRRLSKFIKVAEQLKLQEKKRWRLHTKLLMLLIIKRASLH

SEQ ID NO: 9361 - protein, 22 aa, synthetic construct
RFRFMPKLIKWLKKAKLTSQLL

SEQ ID NO: 9362 - protein, 31 aa, synthetic construct
KYKFLKRLWKKLRKSKPALALHKANLGSKHE

SEQ ID NO: 9363 - protein, 32 aa, synthetic construct
RLKLLRRYYKKLHSYLFKKAKTAKQADLRETR

SEQ ID NO: 9364 - protein, 45 aa, synthetic construct
KLKLLCRWLRYLRCARRKLFPKLRAMPIAKPNRKFSHNIRLVKAS

SEQ ID NO: 9365 - protein, 90 aa, synthetic construct
LFRLLKRFLRRIKRFRRRMVLVAALAQADAKRAIKPWRRNIRRVIRFDAKAPAANWFTTDMLPLTKRWAEYVRAAECSYRARATLRLQGK

SEQ ID NO: 9366 - protein, 30 aa, synthetic construct
MLRFMCKLFRMLRTVRRALQKFARRALCAG

SEQ ID NO: 9367 - protein, 20 aa, synthetic construct
LYRWFKKLWKFLKPLLGLDK

SEQ ID NO: 9368 - protein, 34 aa, synthetic construct
ILKLYKRLIKKICKAMRDLLTKAQRQSMAKYATL

SEQ ID NO: 9369 - protein, 85 aa, synthetic construct
RLRYLCRFLKRFRKDVCMKELYKYFREKKLRACINQRAKLLALARLDQLFRDDHIASFHNREALLRPLKYRFKRLLTMYAQLALA

SEQ ID NO: 9370 - protein, 43 aa, synthetic construct
YWRLLKRYYKKLCRLKLALSNKIYDLAFAKAAIAKSKGRWAVE

SEQ ID NO: 9371 - protein, 23 aa, synthetic construct
FWRMMNKLYKKLRRLLDHHRAKA

SEQ ID NO: 9372 - protein, 49 aa, synthetic construct
RMKFLRKFWRYIKRLALTKLKLAMQRERLKWWAQEFEKVAHKRFTLVAM

SEQ ID NO: 9373 - protein, 93 aa, synthetic construct
RLRWFSRMLKRYKKCWALAKRHRFTNKYQRAKHLLIPLTARYLRKKAHYKPTALKARRLQSDRLQQLLMRRAKAASHLFRKYFNGFLMALNWL

SEQ ID NO: 9374 - protein, 43 aa, synthetic construct
LLRIWNRLYKKLRRRRTAAKMRLAYAMQGCHPDRLKGADPYLA

SEQ ID NO: 9375 - protein, 30 aa, synthetic construct
RFKLYPRWLRKLNRVRRQTGARQLLACCPA

SEQ ID NO: 9376 - protein, 51 aa, synthetic construct
RLKLLPRFLKRLKKKWALIQKGAALPWIGLWAATMRDTKELQLMVLRQKTD

SEQ ID NO: 9377 - protein, 33 aa, synthetic construct
RFKLIKKLYKMWKRKFLKALLFRHNLYAAVTAR

SEQ ID NO: 9378 - protein, 21 aa, synthetic construct
RLRYFPKYLKRYRRAAGALKL

SEQ ID NO: 9379 - protein, 38 aa, synthetic construct
KLKLLCRMLKRFRRAQQKRALLVAWKKAIKKLAVSWDQ

SEQ ID NO: 9380 - protein, 52 aa, synthetic construct
RFKLFSRWFRRMQSARSKAFKRLLAAERELNFAARTARRRAAKRHYLYVVCV

SEQ ID NO: 9381 - protein, 43 aa, synthetic construct
LMRMLPRLYKRLKREKAHKQRYYKSICAIRLPRKVLLKKALMM

SEQ ID NO: 9382 - protein, 76 aa, synthetic construct
RYKLWRKLLRFLRRILLHAKWCTQMLRLLAGPNVAAGASRKARAARTKRAGKYTWVQTLVLRNAATRVRWARMSKK

SEQ ID NO: 9383 - protein, 20 aa, synthetic construct
RLKLFRKFFKYLPRIKSLAM

SEQ ID NO: 9384 - protein, 28 aa, synthetic construct
FYRLYRKLWKLFKREAHATSAYYSAALK

SEQ ID NO: 9385 - protein, 38 aa, synthetic construct
IMKLLHRYFKRMRKICPLSALIYLEVRAWAGRLLCKRK

SEQ ID NO: 9386 - protein, 52 aa, synthetic construct
KLRLFHRLFRRIRKRDAASAINLWHCKEKLKAHKILYCLRKYKESPAKAFDT

SEQ ID NO: 9387 - protein, 64 aa, synthetic construct
KWKYFPRLLKKLKKKNRNRNSVCRAAYLLKIAACKAQYLAWRAAFGVRKDMYYTRAMIELALKK

SEQ ID NO: 9388 - protein, 43 aa, synthetic construct
RIKFFTRMLRFLKKLLTAYRSALKARRLLRYQRYALSKQPLFW

SEQ ID NO: 9389 - protein, 44 aa, synthetic construct
KYRLFKKFLRKWCRWKMDKSLLKPTAYSAATFFAKAAILNRSKA

SEQ ID NO: 9390 - protein, 60 aa, synthetic construct
RLKLLNRLMKKLHCLARLSSSNKNLAETGEKAHFLRRQKTMFAMALRNASKEFVRAAKVA

SEQ ID NO: 9391 - protein, 58 aa, synthetic construct
KFRYYKRYYRLWHPRKLKLAAENIAGDMAKAQEFLLALRQALNRLSKTAKKQNPALCY

SEQ ID NO: 9392 - protein, 30 aa, synthetic construct
KFKLIRRLWKLMKNFRSARAANKARFKYLL

SEQ ID NO: 9393 - protein, 57 aa, synthetic construct
KWKYFPKMIKLFRRKLPKLLKVDAKTATSFLLRGLRAKAWLPLKGVWLFLEFLLEKW

SEQ ID NO: 9394 - protein, 34 aa, synthetic construct
RLKWFKKLFKRLRRMLWIELRCLYLARTVGKCSL

SEQ ID NO: 9395 - protein, 54 aa, synthetic construct
IFKLFCKLFRLMRKPGRLRLGPKNLLDLVLAQARKRKKDCARILQCVSAMAKAH

SEQ ID NO: 9396 - protein, 50 aa, synthetic construct
LYKLFRKIFRRLNCPRRRRGALELVYITKYAYGIAKALKKNKEAAAETRM

SEQ ID NO: 9397 - protein, 46 aa, synthetic construct
RLKFWKKFWKRFRKLIARLRHRAGLCCTLHFVAAKWRKMTADGAAH

SEQ ID NO: 9398 - protein, 39 aa, synthetic construct
KWKFWKKFYKMFKKACLSAKMRLACKKLSGKAEFHARAA

SEQ ID NO: 9399 - protein, 23 aa, synthetic construct
RFKWMRRFFRLLPKQPAHYALKA

SEQ ID NO: 9400 - protein, 28 aa, synthetic construct
RLKLWNRYIRRLRKWSLTVALSAHAHDL

SEQ ID NO: 9401 - protein, 38 aa, synthetic construct
RLRYLPRFLKIFQNWAKKLRRVEQARCLSAAALAFVLK

SEQ ID NO: 9402 - protein, 38 aa, synthetic construct
KLKWIKKFFRFYRQWFKVYALRKLKWLPLGLEKRDADL

SEQ ID NO: 9403 - protein, 42 aa, synthetic construct
RWKYFNRFWKYLKCLAAKCRPAQKRAKRQDLAARKWVKMPLA

SEQ ID NO: 9404 - protein, 53 aa, synthetic construct
RFKILKRWIKLLKKPQKGAARKLLRNALNCVAAARCRDLEASKRDPHRIGVCR

SEQ ID NO: 9405 - protein, 48 aa, synthetic construct
MMKWLKKFIRRFRKAKKILRQLFFMFAFRPALPERQMLLAKLWLNIKL

SEQ ID NO: 9406 - protein, 61 aa, synthetic construct
RFRMYQRLFRLYRQKAMAACYKLRKLAWTCADVLCLKAQVAWKKRRYCCLTLKHHRSKKYA

SEQ ID NO: 9407 - protein, 49 aa, synthetic construct
RMRILRRFWKFLKPLRLSADGWLFKDKNRLLMNFRGTLLARQRSKYAAG

SEQ ID NO: 9408 - protein, 76 aa, synthetic construct
IMRLYRRMLKYLNNAWKWYYKRKWAAQIAMNACRGWAFKLMVALRQWLLRRLKKDRKRRLARDKEMKENHKLQRKE

SEQ ID NO: 9409 - protein, 28 aa, synthetic construct
LWKFYKRLLKKMCCNLRGRRASVNADKL

SEQ ID NO: 9410 - protein, 64 aa, synthetic construct
FLKILPRLLRFMRNRRRAMRILALKHWRTKNAKGERAAQVAYSMRKKPGPKYKLYSCWAAARAA

SEQ ID NO: 9411 - protein, 39 aa, synthetic construct
RFKFLKKMFKFLRRKALKALINLYLKRAVMKIHAQKACS

SEQ ID NO: 9412 - protein, 37 aa, synthetic construct
WWRLFKKLYRRLSNYKLWARRCRKLYAAAFPLRNARL

SEQ ID NO: 9413 - protein, 21 aa, synthetic construct
LMRIMPKFLRLIQKKQALLDA

SEQ ID NO: 9414 - protein, 37 aa, synthetic construct
WYKLLQRYFKIMKQKGARKLLKKMLIARDFAARPDRI

SEQ ID NO: 9415 - protein, 40 aa, synthetic construct
RWKYWQKMIRRFHKQAKAKKYLSLDLYTKLVLLQLASKRR

SEQ ID NO: 9416 - protein, 40 aa, synthetic construct
FLRWFQRYLKLIKKRHSKLKRTCKQWWYARMAEAARLRMG

SEQ ID NO: 9417 - protein, 35 aa, synthetic construct
KFKYLSRFLKLMHKHDKELLRLSYVYKWLAMLRAR

SEQ ID NO: 9418 - protein, 41 aa, synthetic construct
RFRLLSKLWRRFRKAKEFQAAKKEALRHKLFLTALKLKSKH

SEQ ID NO: 9419 - protein, 33 aa, synthetic construct
FLRMFRKLIRLYRRRRAAALKLFLNDCRVSSKE

SEQ ID NO: 9420 - protein, 32 aa, synthetic construct
LMKMLRRMLKKLNKAMLKCRLPWFLYRAPKQR

SEQ ID NO: 9421 - protein, 22 aa, synthetic construct
LLKMMCRLLKKINTRLTIAMLR

SEQ ID NO: 9422 - protein, 37 aa, synthetic construct
MLKIYRKWWRKLQTKARALRKAKCLYLTDATPRLPDK

SEQ ID NO: 9423 - protein, 26 aa, synthetic construct
KLKLISKLLRKLRRLQCAKQDKLAFP

SEQ ID NO: 9424 - protein, 49 aa, synthetic construct
YFRFFHRLLKKYPKASRDKAFAFACLWAAKRLRLPGRNAKRCCHRAPYG

SEQ ID NO: 9425 - protein, 62 aa, synthetic construct
KYKFYRRMLRRLRRFVARDAHTRAKRAFAKAQDLLRWCARQRHAAQEAYKAREMKRLKMCLL

SEQ ID NO: 9426 - protein, 42 aa, synthetic construct
KFRLLHKYLKRWTKRLLGRLQASYKWPAPRCRRILLRQNWLA

SEQ ID NO: 9427 - protein, 28 aa, synthetic construct
RWRYLQRLWKMWTKMRLSIKLKSLLKVA

SEQ ID NO: 9428 - protein, 30 aa, synthetic construct
FMKMLRKLFRRLPKKADYIMKISRLLLWAR

SEQ ID NO: 9429 - protein, 24 aa, synthetic construct
RLRIMRRIFKWMKKKATLHMAILA

SEQ ID NO: 9430 - protein, 23 aa, synthetic construct
LLRFLRKFFKRYRTNAKAMLMAL

SEQ ID NO: 9431 - protein, 69 aa, synthetic construct
KMRLLKRLLRILQKGLLNCARAFRKIIGTRLALHAYGDKCVDRKKVLKMKLLALPLCELSILRQPLWWR

SEQ ID NO: 9432 - protein, 70 aa, synthetic construct
MIKILKRLMKLLKNCVRKALLAQEAKMMITHSNFCRAAWLRRLHLRYAKLRRNKVPALARAFCWHIMRPR

SEQ ID NO: 9433 - protein, 23 aa, synthetic construct
ILKLLPRWIRLFRCQQRIHKARA

SEQ ID NO: 9434 - protein, 20 aa, synthetic construct
WFKFLKRLYRLLSCLKQMRR

SEQ ID NO: 9435 - protein, 20 aa, synthetic construct
RWKMISRMLKRLRKLEACLP

SEQ ID NO: 9436 - protein, 27 aa, synthetic construct
KMRFLPKLIKKMSRKNLAALLNDVRTY

SEQ ID NO: 9437 - protein, 22 aa, synthetic construct
LYRFLCKWLKLYRRKHNLGVKL

SEQ ID NO: 9438 - protein, 36 aa, synthetic construct
KMKLMKKWLRLFKRKLLALGRDRLFLDNAVNSNKLY

SEQ ID NO: 9439 - protein, 41 aa, synthetic construct
RIRIFTKMYRYFRKAAPAFLAKMRLARSCANLILAKKMRWS

SEQ ID NO: 9440 - protein, 50 aa, synthetic construct
RIKLMRRFYKFWKTHTGELLAAKMLKGAFPSRAHAKHRYLLLRSRRKVAG

SEQ ID NO: 9441 - protein, 48 aa, synthetic construct
FYKLLRRLFRRFKSEQATPLLAQCARRLMPYNGKAQLARKCRANLAES

SEQ ID NO: 9442 - protein, 74 aa, synthetic construct
KIRLMRKIFRWWHTCRAKTKRQDLRYKKKAAMVLRRPFFLLRMLRAWLRKLDRRLKTRMAANIFSSAQIPLDRP

SEQ ID NO: 9443 - protein, 21 aa, synthetic construct
RLKYMKRLLKLIRTARNFCCA

SEQ ID NO: 9444 - protein, 39 aa, synthetic construct
KLKILCRWYKRFRKTKLRAEALVLPFTIQTAQTKKRRLL

SEQ ID NO: 9445 - protein, 23 aa, synthetic construct
FYKILCKLWKKLKHHLKAGVCLK

SEQ ID NO: 9446 - protein, 29 aa, synthetic construct
IFKMMHRILRRMKRKLRNAVALQRQNLAG

SEQ ID NO: 9447 - protein, 34 aa, synthetic construct
YLRWWRRLFRMFTKKLEAPKPDKRWLDKIAAYLK

SEQ ID NO: 9448 - protein, 31 aa, synthetic construct
RLKMLPRLIRWYSRILRLKRKNQYARKLKLA

SEQ ID NO: 9449 - protein, 30 aa, synthetic construct
LWRMLRKYFKWMKTVAVCQKAARVLQARAL

SEQ ID NO: 9450 - protein, 37 aa, synthetic construct
LLRWFKKIYRRLTRAPWIHIRCKAPKSALAKKAFTAF

SEQ ID NO: 9451 - protein, 50 aa, synthetic construct
WWKWFRKMLKKLNKRLLDKDIMKSARRRLAKCKADAFNKLGNGLKYQSAE

SEQ ID NO: 9452 - protein, 30 aa, synthetic construct
RLRWFSKLWKKLRTLTNTKKKQLLFLLNHP

SEQ ID NO: 9453 - protein, 40 aa, synthetic construct
FFKIMKRYLRMIKKALRKAGRQSRMKLSNVELKHSLLMAA

SEQ ID NO: 9454 - protein, 40 aa, synthetic construct
RIKFLRKLMKWFKRADARAYYHKAKLSGFAKIPWRNSLLQ

SEQ ID NO: 9455 - protein, 79 aa, synthetic construct
KMKLYKRYFKFYRKAALMGKLVEYRNPKAPLKRARALTLASYRALLAEQEGLRNCDMDLALVHQLQTRRRNKLRKALFM

SEQ ID NO: 9456 - protein, 28 aa, synthetic construct
FWRLYSKLLKKLKKGRLHAEVPNLALCE

SEQ ID NO: 9457 - protein, 54 aa, synthetic construct
YLKMWKRLLKYLKSSLIAQQKRILIEFNITLKALKLKARSRANSKKLKRWWATV

SEQ ID NO: 9458 - protein, 32 aa, synthetic construct
RLRMLKRLLKRLKQLMHSLIYGYKPFSAGLAN

SEQ ID NO: 9459 - protein, 60 aa, synthetic construct
LFKMISRFYKMFPKKLALKRRLLAYPAERGTLRRVACARLKFYLAQRWVSYFHLRRLMRC

SEQ ID NO: 9460 - protein, 41 aa, synthetic construct
FFKLLRKLLRRLNRLKRACCLCRQLGSLYEVLQKLLTPMID

SEQ ID NO: 9461 - protein, 29 aa, synthetic construct
RLRLICRLFKFICRKICLMLKALSSKRTA

SEQ ID NO: 9462 - protein, 24 aa, synthetic construct
LLKWWCKLMRLLRQVKDWKARTRL

SEQ ID NO: 9463 - protein, 73 aa, synthetic construct
FMRLWKRYMRKYCCANKLRRLFLLCPLLLKKPLKAHMAGLKKSRLLKERKLKDRVHRLVAKGECPAKPYLAVE

SEQ ID NO: 9464 - protein, 35 aa, synthetic construct
YLKFFSRIIRLYHKAIVTLAPALLKKIAKRELACR

SEQ ID NO: 9465 - protein, 58 aa, synthetic construct
FLRFLRKILRKFCKDLKKVKSDQQMLRLKKLAFTDTNSLCKLSAGKRRSRARANRSHL

SEQ ID NO: 9466 - protein, 69 aa, synthetic construct
KWRFLRKMLRRIKRIHAMLRSQLWHLAAFLKRLCIRLNVRESLLMSPKCKAQRLIAGNVPRRLAFPALA

SEQ ID NO: 9467 - protein, 55 aa, synthetic construct
KMRFLRKFFKLLRSSVDLMHQGFLKLRVLFLFPAFRRRLYLLGLRAHLAPKVRCL

SEQ ID NO: 9468 - protein, 57 aa, synthetic construct
KMKILKKLLRKFHRIFCVGIHLATRARRGAALINFKFRAWLIYEFMRALRHRRKILA

SEQ ID NO: 9469 - protein, 70 aa, synthetic construct
IYRLLKKLFKRWRTAQAKLLHALRLTACELKWNAREEHTKRAFARAADPKVQKWKRAAAGWYFEAAAPAM

SEQ ID NO: 9470 - protein, 70 aa, synthetic construct
RLRLLKKLLKLLKKMALKKKCARIAMLSLEEKNQKPMLGPMCAAAQLYMRKLRCVPDRYATKRLILCDAR

SEQ ID NO: 9471 - protein, 66 aa, synthetic construct
KLKILQKMYKRLRTKLSGNARKRSSAKPKRPAATNQYACRCAAQLDANSLRRRRYADRSTTYLKWA

SEQ ID NO: 9472 - protein, 48 aa, synthetic construct
IMRLFKRFFRRYRKLMLLICTRHLRFDGAQLALCPVERDLRRHAAKAR

SEQ ID NO: 9473 - protein, 48 aa, synthetic construct
LWKLLKKLMKRFRHPMAKLLRALRADHLNCEYYPNARPLVMHRARKVH

SEQ ID NO: 9474 - protein, 79 aa, synthetic construct
RLKMYCRLMRKLSKIDDALYKFAAKLYLIAAARARKRFMRIRIRDHWAVKAQIAAFALCKVRNGMAKYYMSRLANLMML

SEQ ID NO: 9475 - protein, 27 aa, synthetic construct
RLRMLRRMIKLFRSALRQLIRQANTDK

SEQ ID NO: 9476 - protein, 41 aa, synthetic construct
LYKLLQKLYRIWTPCRAMRLKEAYFLQAILKLTRELLMKKF

SEQ ID NO: 9477 - protein, 20 aa, synthetic construct
LFKLWRRFLRLYKNALYKKA

SEQ ID NO: 9478 - protein, 43 aa, synthetic construct
WLKIWCKWYKRYTCKNWWHSCAFLKKAKRKLARCLRLLTRRLP

SEQ ID NO: 9479 - protein, 20 aa, synthetic construct
KLKILPRILKKLKHNVAHAD

SEQ ID NO: 9480 - protein, 44 aa, synthetic construct
RIKMYKRMLKIWHHLAKAPELRKPMRAFLYRAGRAKKAALKVCD

SEQ ID NO: 9481 - protein, 72 aa, synthetic construct
MLKLLCRIMKILCKAKRPRERRVGKSLVARLKRRKSAATRTVYKQKAELLYIGDAAKYINRLNDLKADPRLA

SEQ ID NO: 9482 - protein, 48 aa, synthetic construct
LYKLWRKLLKKLHPRWKADAPPARVCRALRRAWTELKKWARRKAATTV

SEQ ID NO: 9483 - protein, 36 aa, synthetic construct
IFKWIRKLLRIYPCANAIKFNRAARMTRAELKLCLA

SEQ ID NO: 9484 - protein, 51 aa, synthetic construct
LWKMLHKLWKRYKKRKPALFDYRILFWANRLGARKNNAKKNLRKCPKEPLA

SEQ ID NO: 9485 - protein, 36 aa, synthetic construct
LFRYFNRLFRFWKKKRFKDELLNARKLLADARLKKA

SEQ ID NO: 9486 - protein, 39 aa, synthetic construct
MMKYYRRLLRFLRRYKDWRLHARDMAPRLKAVRVAMMVA

SEQ ID NO: 9487 - protein, 27 aa, synthetic construct
RLRFFRRMLKKIKKLTGLAAITTGCYA

SEQ ID NO: 9488 - protein, 78 aa, synthetic construct
IYKLMKKLLKYFKREKRDKRGVERKKTKTKLARQKYCDELHLLLLERAAPQARWRKALALFVEYHRKTKLKQRLRQLV

SEQ ID NO: 9489 - protein, 37 aa, synthetic construct
YLKMFRRYYRKLRKQLKIDKCTWAALLWKAEATRQAL

SEQ ID NO: 9490 - protein, 99 aa, synthetic construct
RLKIFTKLWRLYKNRDTARAKKSKRALWRKASYVNRYAKLALCATAHVFRDKSLKKAHAYKRRRMRPQRKRYWKATLGRKLLATLVAKDRRAAHILRLL

SEQ ID NO: 9491 - protein, 47 aa, synthetic construct
KIKLIKKMLRFYKQYGCRLARGRKMPSPLEKAHKKALLLLHRLQAHP

SEQ ID NO: 9492 - protein, 22 aa, synthetic construct
KFRLLKKLMKFLKHLIVLATKK

SEQ ID NO: 9493 - protein, 58 aa, synthetic construct
WIKFFRKLMKLYNRAPALEDLLDRSQRKIAKARHWLDLNGRLLYILKRRRTAKTMVAR

SEQ ID NO: 9494 - protein, 60 aa, synthetic construct
LFRMFPKLFRKYRQAPQCGMWLLALKLKRLADKLVKRLRGLQFALFKMKKIRWELMFGQA

SEQ ID NO: 9495 - protein, 40 aa, synthetic construct
LYKWFCKIMRRWKNVRGALLLLPRWTLPALLWRTLKAHNL

SEQ ID NO: 9496 - protein, 40 aa, synthetic construct
RLRLFSKFYKRFQRLLSSLPLDRQKHLKIAGKNLKVAMKP

SEQ ID NO: 9497 - protein, 98 aa, synthetic construct
RMRYLRRYMRFFQKLRKFKRTRKNACHRKRKQWGRCPWRARLLKYLSLLMHAILSIGLDDRNLFLEARAHAARRANAKAPRAHQSAAALGAYYIARHE

SEQ ID NO: 9498 - protein, 27 aa, synthetic construct
RLKLWRKFIRKYHKLEATARLWMLFLA

SEQ ID NO: 9499 - protein, 68 aa, synthetic construct
RLRLFRKILKMLCHLRLQLPIACHEKMKYSKNQNGKARLLHRLRRMAFQVNFVTRRRAACARAPMARL

SEQ ID NO: 9500 - protein, 68 aa, synthetic construct
WLRLMRKLWRKLPKMNIPHKKRAFKKAFTLLKKYKLLHFPEDAYVRKANARAYKKMYHAMMLAEKRGR

SEQ ID NO: 9501 - protein, 72 aa, synthetic construct
IYRLFPKFIRRFRRRDPNCLDKQALHRKALLNRAKPFLSKQVTKKLKLPNKRCRLEGNNLLKSLLAFAKLHN

SEQ ID NO: 9502 - protein, 97 aa, synthetic construct
KLKIFSRFLKFLRCLKPREAILNRAEIRTLQKQRQKKVPLDWARRREKHRDLAASRRLFSRLDKHRAAGLRRVNKLVWDHCARANLYTYAKKELNLH

SEQ ID NO: 9503 - protein, 44 aa, synthetic construct
LIRFLHKMLRLFRSHWAVEKAVRKYAKKRLEKHLASKKATLNPT

SEQ ID NO: 9504 - protein, 41 aa, synthetic construct
FLKIMKRFLRWLRTRNLLFLKAREPMRAQKPTLRVKCVAEK

SEQ ID NO: 9505 - protein, 38 aa, synthetic construct
YLKFMKRYFKLYRRFLRVRHLKLYALACRCNKTLAQRM

SEQ ID NO: 9506 - protein, 29 aa, synthetic construct
KLKLLTRFIRIYKKRHYRLCALCWQKFLT

SEQ ID NO: 9507 - protein, 50 aa, synthetic construct
MYKWFKKMLRRWRRRRLDLHRMRLLDMALVFTLMKRAMIKFNAFLPLKTL

SEQ ID NO: 9508 - protein, 44 aa, synthetic construct
RFKYFKRFFRKLQCLCGKRAQWAISQALRYTRMHARAAKRKAWA

SEQ ID NO: 9509 - protein, 34 aa, synthetic construct
MFKFLSKLLKFLRHWFWRKAYRLKKMLLWHQARD

SEQ ID NO: 9510 - protein, 30 aa, synthetic construct
FLRIIRKLLKKIKKACAKKRLSNRLACHLN

SEQ ID NO: 9511 - protein, 25 aa, synthetic construct
LLRLIQRYIKRFRRLAACCKFQRHT

SEQ ID NO: 9512 - protein, 39 aa, synthetic construct
RIRLYQRLLKFWKKKALAHEKAKILNWAAYKSAGWIQAA

SEQ ID NO: 9513 - protein, 50 aa, synthetic construct
RLKLIRKLMRKWTRKERLPADSRLLVFLRLNVNACDAQAVALIHAYDKKE

SEQ ID NO: 9514 - protein, 42 aa, synthetic construct
RIKMLTKYFRLYRRRLRKRTLRMAAGLALRNHLAVIQRFFRH

SEQ ID NO: 9515 - protein, 36 aa, synthetic construct
RIRLMPKLMKKLQKKGRRRAAPLPPLLRPTETLQRA

SEQ ID NO: 9516 - protein, 34 aa, synthetic construct
KFRLFRKYLKRLRQAEHKIANPLVALSHTGRAKY

SEQ ID NO: 9517 - protein, 31 aa, synthetic construct
KMKMLRRFLRKMRKAARALCPRYGRIALFHM

SEQ ID NO: 9518 - protein, 50 aa, synthetic construct
RLKFIRRMMRKFRHLPAKKLSIMIARAMFMHGVFPALKRALLRRLLKPKY

SEQ ID NO: 9519 - protein, 95 aa, synthetic construct
KIRLFPKMYRLLTPWFSALVCAHRARYLNHRSRPRKEWFMLAHLHLTWAAKSAPLLKRSARKRKALYCIIKQRLRRCKAHGLFQEFRNRALKARA

SEQ ID NO: 9520 - protein, 34 aa, synthetic construct
YLKLFCKFLRRLKRKLTAKGDCYHKANCRDAVCL

SEQ ID NO: 9521 - protein, 34 aa, synthetic construct
RIKLLKRMLRMFKKDRNLALDLAFRPIRLLSRCD

SEQ ID NO: 9522 - protein, 38 aa, synthetic construct
LLKLIKRYYRMFKKSRIKRVGLGRRLAAHALAWRPERF

SEQ ID NO: 9523 - protein, 60 aa, synthetic construct
LLRLLKKMFRLWNKGRMLATRDYARYKREFLRLKCRNRTAAKRDEMKCGCAAGEARADKL

SEQ ID NO: 9524 - protein, 92 aa, synthetic construct
KLRFLRRLWKIMNRHAAKRYKKILYRHLCEARRLECEFCAQRKLEFAAWAHKKKAPRILRYVLAKLKSALHAKKHRDIAVIKALDWHWAARL

SEQ ID NO: 9525 - protein, 26 aa, synthetic construct
KLRLYHRFYKKLKTFLLAECWKAAKN

SEQ ID NO: 9526 - protein, 22 aa, synthetic construct
RFKLLRRIWKLFRTLLNRNQFA

SEQ ID NO: 9527 - protein, 32 aa, synthetic construct
MWKYYRRLLKKWRQYKKLIARAAAIAEKDHRS

SEQ ID NO: 9528 - protein, 85 aa, synthetic construct
MLKFLNRIFRKLKNLKLKCHLADMAPWFKARLRYAQYLRMHLTVKEWLRHRAVLALARSQKRLTVRMAARVTSRKVWWKLKSKVW

SEQ ID NO: 9529 - protein, 67 aa, synthetic construct
RLRYFKKFLRLLRRQDRALRLAGALLHAENIARERKNKIAMYARDGLMKSFQEARIFFITLALKVRN

SEQ ID NO: 9530 - protein, 21 aa, synthetic construct
LFRYLCKMFKRWKPKDFAALK

SEQ ID NO: 9531 - protein, 54 aa, synthetic construct
KLRWYKKMLKYFKRFKYWRFIKGKELNMAKDALLWTLRKHLAKWAHFAARARNG

SEQ ID NO: 9532 - protein, 29 aa, synthetic construct
KLRLMSRIMKLFRKQKSKSLYKTLVHLDA

SEQ ID NO: 9533 - protein, 44 aa, synthetic construct
RLRLMSRMYKKMKKSKRALTSAVASALKKYPYPGLLATRACTLA

SEQ ID NO: 9534 - protein, 33 aa, synthetic construct
RMRWLRRMFKKLRSLLLCRWLCYCKRMEIRAAP

SEQ ID NO: 9535 - protein, 34 aa, synthetic construct
KLKYWKKLIRRLKPKHKRWAAESGTLLRLQSAAN

SEQ ID NO: 9536 - protein, 32 aa, synthetic construct
KLKLFSKFLRKWRKRLECGAGRASPGRLTLLL

SEQ ID NO: 9537 - protein, 55 aa, synthetic construct
RMRLLPRWWKKFPKLVAGAVAKLALTIVRLLKKRPMKKWILNHYFRKLRKVACFA

SEQ ID NO: 9538 - protein, 34 aa, synthetic construct
LMKFFRKWLKKFKQRASYKRKARLKLALDELRCL

SEQ ID NO: 9539 - protein, 43 aa, synthetic construct
LFRFIKRLLRMLHKLLFECCRLARAKEMVAKCDPLRDRLPVTA

SEQ ID NO: 9540 - protein, 28 aa, synthetic construct
RFRWLNRLWKKMPQKLQRLSPFHRLLAA

SEQ ID NO: 9541 - protein, 21 aa, synthetic construct
RIKFYCRLMRWLTRMAKADLA

SEQ ID NO: 9542 - protein, 29 aa, synthetic construct
RLRWYKKFFKWISRHLLYAGELTAAKMKL

SEQ ID NO: 9543 - protein, 84 aa, synthetic construct
LLRLFKKFWKIYKKRAFARAMIISKARKKREKYARRRHRAANLRKRKNDDKALLCWPLYLMHRNLGGRARDSKHQSLMQELLRK

SEQ ID NO: 9544 - protein, 40 aa, synthetic construct
KYKMLKRLLRRLKRRIWPAHNLDCVAYLKRSIWLLALGLK

SEQ ID NO: 9545 - protein, 27 aa, synthetic construct
LIRFYKKFLRKLKRMARTLLIALAWEN

SEQ ID NO: 9546 - protein, 39 aa, synthetic construct
KLKILHRLLKMIRRRQRNNNKDLHALAVLRQATARDKAL

SEQ ID NO: 9547 - protein, 26 aa, synthetic construct
LFRIYKRLLRRLKNYCAIHRHMRLLR

SEQ ID NO: 9548 - protein, 25 aa, synthetic construct
RFKILRKILKFLHKACDPLLRKLVY

SEQ ID NO: 9549 - protein, 70 aa, synthetic construct
LLRFMKKYYRKIRTLIHQVLGIVARKRKALRQAKCKRKLLEAAHHKKRVAKCAKIKGEYYLATLYKQDLR

SEQ ID NO: 9550 - protein, 78 aa, synthetic construct
LYRLLRKMLRFLRKSRLAAVWSLPHPLLAKFEEKKKLALQTCAKSLECCQEKPLAGRRKTSCMEFLADAVRPRRAKAR

SEQ ID NO: 9551 - protein, 87 aa, synthetic construct
LWKFYKRLWKKFTKRLKRKKNWLNLCLLHGNWCRLRCLEFEKMAWAAYRYIAILRLYCRLLKYAKTRARALGKLWLKKISAECCQKR

SEQ ID NO: 9552 - protein, 23 aa, synthetic construct
KLRWLKRILKKLQKKAYSNPATY

SEQ ID NO: 9553 - protein, 63 aa, synthetic construct
LLKLMSKMYRKLKHRCAQKTYHKKLRALMDAKNLTRNFKRLTLRPAQPLRQHLVEWRYRLTKL

SEQ ID NO: 9554 - protein, 60 aa, synthetic construct
FIRMITRLMKLFRKCYKEKRKKHMCIWRCRDNLHRTQRLKARLLAKQLKMLRLARADPPA

SEQ ID NO: 9555 - protein, 45 aa, synthetic construct
LLKMFPKWMRILPQQKTARKAKFSLERRDKVPRLRALERIASKRA

SEQ ID NO: 9556 - protein, 46 aa, synthetic construct
LIKMFKKFFKIFRRRQKRTALGLLCLKRARECARVWMWAKWLYLKL

SEQ ID NO: 9557 - protein, 32 aa, synthetic construct
LIRWFRKYIKKMQNRKLIFRLLQYSARLALRA

SEQ ID NO: 9558 - protein, 52 aa, synthetic construct
RFRLYSKLMRFLRRFINKGKLCRALGKAHIRWKLLALCRHLAAIACAWERDR

SEQ ID NO: 9559 - protein, 31 aa, synthetic construct
KFKLFRRFWKLFRPGVRAIEKRELLILCLAK

SEQ ID NO: 9560 - protein, 65 aa, synthetic construct
LYRFLPRLWKKFPKRWAYMTSAALKLPRWRMNRKNLEVLPLRARRRTFNAGKLLQFAAALQKTVA

SEQ ID NO: 9561 - protein, 60 aa, synthetic construct
RFKFIKKFLKLFKKAAAADKREPKKKVAKRTWNTLADYEGAIRKLAKRLPNEDCKLFLRV

SEQ ID NO: 9562 - protein, 25 aa, synthetic construct
LIKYLKRFWKLLKQKFRRTNRLAAV

SEQ ID NO: 9563 - protein, 35 aa, synthetic construct
RFRLFKRLYRRYKRFPPAKPQQTRLKAMMILLLLL

SEQ ID NO: 9564 - protein, 49 aa, synthetic construct
RMKLFKKMYRKICSALNAAKAVLGRQWTQARGDLRAEKMSSPAKVLLKA

SEQ ID NO: 9565 - protein, 30 aa, synthetic construct
KLRWLKKLYKWLQTKLTNVLKTPNRAKSGR

SEQ ID NO: 9566 - protein, 56 aa, synthetic construct
KLKFLRKFIRMLRRAWVPAVAYDSDNLKAYMRAFEAGSARRRAKCRWRLCSALCTA

SEQ ID NO: 9567 - protein, 45 aa, synthetic construct
RFKLLSRFWKRMNRACKKKACLLLCALMMVRASTKKEKILRARKT

SEQ ID NO: 9568 - protein, 46 aa, synthetic construct
RLKLIKRLLKLIHKKWEHLKKRAIGRIKRVAMLSKESVILLALARL

SEQ ID NO: 9569 - protein, 31 aa, synthetic construct
RWKMIKRLFRRFHRKNADAAKIAMKLAVKQA

SEQ ID NO: 9570 - protein, 72 aa, synthetic construct
LWKLITKMLRMFKRSKFNRQLRSFAQARIDRSKCAKLALIVGKRFKDAKHKFKWLFALANATKNRKAKRQAY

SEQ ID NO: 9571 - protein, 25 aa, synthetic construct
KFKFYRKIFKLLRSKALTPAYATCK

SEQ ID NO: 9572 - protein, 45 aa, synthetic construct
RWRFLRRLFRFLCRPAKWLLLLLRAAKQHRLRVNMLTLHRLVEMC

SEQ ID NO: 9573 - protein, 48 aa, synthetic construct
MIRLWRRLMRKFRRLAHQDPELRLRLARKRIRKANCALRWARWAPNVT

SEQ ID NO: 9574 - protein, 84 aa, synthetic construct
KLRLLSKFFRRFQKKKRQPPMALKAAAGAEPYLAMPACDALARWRPLKWVLLQAPLMRAHPKTILRKAAKAARMDRRLATRCAL

SEQ ID NO: 9575 - protein, 35 aa, synthetic construct
MFKLLKKYYKRLRRWRLKARRAAMLFTAWYYQRHQ

SEQ ID NO: 9576 - protein, 27 aa, synthetic construct
RWRLYKRYLRKFNRAKFGLAAGASFRW

SEQ ID NO: 9577 - protein, 69 aa, synthetic construct
RWRYITRLWRFLRKKRKPTCQASLRAFKLAQADGLKALNMSSILRMLKRMKHMILCRKNYDLAEAHKAK

SEQ ID NO: 9578 - protein, 25 aa, synthetic construct
KLRWLQRLMRLFRRRVVLSVRPAPS

SEQ ID NO: 9579 - protein, 51 aa, synthetic construct
KLRMLCKMLKFLSRLKAQQEAFGLAKRRLWDRTPFEWWVRLHRAARKLARL

SEQ ID NO: 9580 - protein, 29 aa, synthetic construct
RFKLLKRFMRMLHKLCRHYLHYVRLKGLY

SEQ ID NO: 9581 - protein, 28 aa, synthetic construct
KLRFWTKWIRKLKREAADCMLLALLRFA

SEQ ID NO: 9582 - protein, 47 aa, synthetic construct
KMRYLRRLWRFMRPWLQVDSAFKAKTLLADRLCLARYRYVNHPLRLA

SEQ ID NO: 9583 - protein, 49 aa, synthetic construct
RLKLMRRMIKRITKEKVFILLTALREHRKYANKLYKHMANLLKLRTPLK

SEQ ID NO: 9584 - protein, 37 aa, synthetic construct
WLKWLKRWLKKMHNHANAAPWKKLATCKTTRALRKKK

SEQ ID NO: 9585 - protein, 40 aa, synthetic construct
KMKLWCRIFKRYNPRWVHCESLGLRLMLLRALRRLAKFNR

SEQ ID NO: 9586 - protein, 26 aa, synthetic construct
WFKLFKKFFRLLRRCAGNELAHAHRK

SEQ ID NO: 9587 - protein, 88 aa, synthetic construct
KFRIFNRLLKKLRQDKLKKAARRPVKKGSIASGNGPWRLIMRKRLIKWSRKKNTKAWLAFKVMIKSHKKYHTLLLASRARALTLYLAS

SEQ ID NO: 9588 - protein, 47 aa, synthetic construct
LLKWLKRFIKKMKRMAWAGAQMRPFAQFSRCGLDLADRKVKRVAKCA

SEQ ID NO: 9589 - protein, 20 aa, synthetic construct
RLRFIRKFLKLYSKDNIDLA

SEQ ID NO: 9590 - protein, 68 aa, synthetic construct
KLRLMRRLLRKIQRKLQKPRKTLARHLRRRSRKDNTDEAYNPNLCKHALSFWVLKYTMAQVLRTRKFL

SEQ ID NO: 9591 - protein, 46 aa, synthetic construct
RMKLYCKLFRRLKKSRACKGRNKGLFKACYKTLWRKLWALLPMKQA

SEQ ID NO: 9592 - protein, 46 aa, synthetic construct
RLRLLQKYLRRYKRMRRLRLNVKLPLFDLLYARNQNQRRRINQAWF

SEQ ID NO: 9593 - protein, 44 aa, synthetic construct
RLRLMTKLYRRFRSLELKAMRARMKKNASLVTAFNEFRRAADPW

SEQ ID NO: 9594 - protein, 30 aa, synthetic construct
KLKLLKRLYRLMRHWNIALDADVDITRFKK

SEQ ID NO: 9595 - protein, 71 aa, synthetic construct
RLKWFCRLWKKFKKALLFLHKLKLFWLGLGPLHNAVGVLRVLHKKDRNAGFHRRAAMPLRLSVMLRKKKQI

SEQ ID NO: 9596 - protein, 34 aa, synthetic construct
LLRFLKRLIRMYCKLAKDRAAHHRLAKHKMSRDL

SEQ ID NO: 9597 - protein, 92 aa, synthetic construct
RLKIWRKLFKIWKRRRGKLHRRKHLVKLPTMLAKHCIIAARNKLAAGGLSLCSVLTACKILKRHDVSAIREADLKEPRKAKKFASEKMLRRK

SEQ ID NO: 9598 - protein, 43 aa, synthetic construct
MMKYFCKIFKRMKKLELRKRGQCGALADPARLEKLKANAKILA

SEQ ID NO: 9599 - protein, 32 aa, synthetic construct
KFKILKRLIRRWRTKDQGRMLKLRLFLYALHL

SEQ ID NO: 9600 - protein, 66 aa, synthetic construct
RYRYLKRLFKLLKNMAKLYAAWKAKDKLMKHNGKLNWLHMLKIQWLAASHKKENAAWLFWWVKRRK

SEQ ID NO: 9601 - protein, 82 aa, synthetic construct
MLKFLQKIFKMMPTMCKAYDALELWANKRFPKAKPLQLFLALALYLLWRGRLRLRLRPLRKERRRVSRVLKRLVSKAGRART

SEQ ID NO: 9602 - protein, 81 aa, synthetic construct
RWKLFKKLLRRMKRKLKKQRARTELNVCAKMSMAARGNKSCAECLRRICKLMMAKFAAKRSCKAQNKLETWAMYWRKFALG

SEQ ID NO: 9603 - protein, 20 aa, synthetic construct
FWRLLKRLMRRLKRQNLAQC

SEQ ID NO: 9604 - protein, 47 aa, synthetic construct
KLKLLKKFFKRLCNAKRLALMEIYLTAGESDRLWFLKFLKWCADQRY

SEQ ID NO: 9605 - protein, 30 aa, synthetic construct
YWRLFHRWFKRFHRALVRQRSLDALKAALL

SEQ ID NO: 9606 - protein, 20 aa, synthetic construct
LLKFMKKLFKKLCKLRALFA

SEQ ID NO: 9607 - protein, 31 aa, synthetic construct
RFKLFNKWLRLMKRALQLLAMIRRVWKIQKA

SEQ ID NO: 9608 - protein, 33 aa, synthetic construct
KLKMMCRIWRRFTTRKRLWLAAALGDLFLCKIA

SEQ ID NO: 9609 - protein, 66 aa, synthetic construct
LFKFFRRWLRRMKNLWANDAKALARERYEPLSYRQIAIHIRAAPTKALKARMRANEAARYKETNKA

SEQ ID NO: 9610 - protein, 73 aa, synthetic construct
IWRIFRRWFRMLRKMLLKAPDKKRKLAKWNRSCGALKECWKLRMKCATCRWKTKIKLAARAQLVALLLKRGVA

SEQ ID NO: 9611 - protein, 55 aa, synthetic construct
LIKIIRRYFRRLTKAAVVKRLKCLAKRLRLMLHFVDARIALKANHDAKLWLNTVF

SEQ ID NO: 9612 - protein, 55 aa, synthetic construct
IIKLMHKLYRRFKRRAAKMSFLAAKQRGPLLVLDARQARGKMRRLKRLSAQRRSS

SEQ ID NO: 9613 - protein, 29 aa, synthetic construct
KLKLLNRFLKKYKRIALLKVWPKGSLWVR

SEQ ID NO: 9614 - protein, 69 aa, synthetic construct
RMKWYKRLMRKYQHHKLGRAAKADRNLKDLSSPLRLRNPDPMKLLALNPLLLHKATGLMAWPIKAMWKR

SEQ ID NO: 9615 - protein, 29 aa, synthetic construct
YIRFWCKLLKRIKSKAAMQLLLLMLATRR

SEQ ID NO: 9616 - protein, 20 aa, synthetic construct
KLKYYSKWLKLLKKCLMLPL

SEQ ID NO: 9617 - protein, 53 aa, synthetic construct
KIRWLRRFFKRLTKAMCRKALKAFCHKKTRPLRYKEWGAALCHAGPKLMAGRK

SEQ ID NO: 9618 - protein, 29 aa, synthetic construct
WLRLLRKYLKKYQRLTLFNMKLVDRELPW

SEQ ID NO: 9619 - protein, 27 aa, synthetic construct
LWKFYKKWFRYFRRKALSNTAARFHAA

SEQ ID NO: 9620 - protein, 60 aa, synthetic construct
KLRLYPKLLKYIPKGAVLYFKNLKQIWAARRAEYKLQTGKVRLLATRSKPKLAKAFYEQM

SEQ ID NO: 9621 - protein, 37 aa, synthetic construct
KLRMLNRLFKFIRHPWRFPRNQARRAERATRAALALT

SEQ ID NO: 9622 - protein, 40 aa, synthetic construct
RWRLLPKWWRILTRARGIRKAAVVLVCMKKEDALFAFRLT

SEQ ID NO: 9623 - protein, 25 aa, synthetic construct
ILKWIRKFYRMFRRQHAHALLAKAT

SEQ ID NO: 9624 - protein, 28 aa, synthetic construct
LYRLWPRWYRLFKRQANRRNRATAGLRS

SEQ ID NO: 9625 - protein, 71 aa, synthetic construct
FLKLYKRFYRKFRKRCKAFRSCRGAATLFGSLARLMLVASRANARKLLKQWYGRGGDRDAWKLARLGWRKK

SEQ ID NO: 9626 - protein, 50 aa, synthetic construct
YFKWFKRFIRFLKTLRLALKRAKHATLLWAPFCFLKVAAPRTNRLATGAK

SEQ ID NO: 9627 - protein, 36 aa, synthetic construct
RFRWLQKFLKFLQKEAMKCHKLWRVTLWLILGKLAR

SEQ ID NO: 9628 - protein, 21 aa, synthetic construct
FFRLLRRYLKKWRTLNRAAAP

SEQ ID NO: 9629 - protein, 21 aa, synthetic construct
WIRWLQKFMRRLRRHWAARAD

SEQ ID NO: 9630 - protein, 74 aa, synthetic construct
LFRLYPKLLKKIKNALAYKLAWFLFQALKIRSPCAKHQRALCRHALKDKYAWLDLFRYAASIGLKGNYPFKRKH

SEQ ID NO: 9631 - protein, 48 aa, synthetic construct
KLKWYRKILRMLKKLAAFMLRKFQKQPAARIEDYKKLTAHLYSACFAK

SEQ ID NO: 9632 - protein, 42 aa, synthetic construct
LIRLWKRLYKKWKTHRRKLEVARAPKKAHAAVYTCLLAHQMA

SEQ ID NO: 9633 - protein, 51 aa, synthetic construct
RLRLWKRFFKLFKTLEWLWRLGRRWKRGRGQLAEALCFYLARANRKRVQLR

SEQ ID NO: 9634 - protein, 34 aa, synthetic construct
RMKMFKRLMRRWKCLEKRAMKALVQDKDAAANPF

SEQ ID NO: 9635 - protein, 44 aa, synthetic construct
RIRFIRKILKKMNHGFKYRRRGKLKIALWKLDATGDLAGLARVA

SEQ ID NO: 9636 - protein, 28 aa, synthetic construct
LLKFLKRWYRIFQKELKDMKMKLNLRFL

SEQ ID NO: 9637 - protein, 79 aa, synthetic construct
KIKWWKRLLKFLSKKRGKRIDKHHAADWQMNYCLHADLRARAAVHRDALNDAEGRQDRRRRYNRKKKAACAAMLLRYLK

SEQ ID NO: 9638 - protein, 37 aa, synthetic construct
KYKLWKRYFRKLNRLVGRRATKLTAAEAFATAAARAN

SEQ ID NO: 9639 - protein, 47 aa, synthetic construct
RLKLFRRLYRKFNKIGRASALAKCCKSAGREFLLYRLIARKAMQADA

SEQ ID NO: 9640 - protein, 31 aa, synthetic construct
IFKMMNKILRLYKSVVRLTCLLILRRRRLKA

SEQ ID NO: 9641 - protein, 30 aa, synthetic construct
LLKFLRRWFRRFRRAHAKKLKTVIMLQNLA

SEQ ID NO: 9642 - protein, 25 aa, synthetic construct
YYRYFHRLLKKWKPLPAMRFARHRL

SEQ ID NO: 9643 - protein, 25 aa, synthetic construct
MLRFWHRLLRRWKQPRKLALCVLTW

SEQ ID NO: 9644 - protein, 25 aa, synthetic construct
KYKWFQRLLRYFKTRALLALQTLRN

SEQ ID NO: 9645 - protein, 27 aa, synthetic construct
YLRLFKKIFKIIKKNTKELATDLMAAK

SEQ ID NO: 9646 - protein, 58 aa, synthetic construct
KLKWFKRWLRYFSRRIWRWEAKCMAGRRLRFQLRGLGLSAIRRATVWAYKKEHARLIL

SEQ ID NO: 9647 - protein, 65 aa, synthetic construct
KYRFLRRLFRMFKRLMFAFFLKIGAGLLAKPRRWYKFKARAPERACQRRGAKAAAANVGDHCQAD

SEQ ID NO: 9648 - protein, 63 aa, synthetic construct
FMRLFRKLLKRMTSAAHKAVPNKIRKLLKKKPTALRWLIARFFFIKLADCYRLHAKAMRMAPE

SEQ ID NO: 9649 - protein, 71 aa, synthetic construct
LYKLMCKMFKKLKKLEWMRARPIRWHRLAVAKKPMRAWGAAKRAMNHKDLLMSKIAIKLLKKATLKRYNHT

SEQ ID NO: 9650 - protein, 69 aa, synthetic construct
FFKFINKLLKKFKKSKRVAQLLHAAIYLLIERLRYKHLHRLNFRRRKKLTALLVDLATQHQIMRKNCMK

SEQ ID NO: 9651 - protein, 38 aa, synthetic construct
ILRFLQRLWRRLTKLHCVAKATHRLIADANRPQLKHHA

SEQ ID NO: 9652 - protein, 57 aa, synthetic construct
RFKWLQKFIRFYRHALARDIRCPKIFRALIWKCKFHRLAEAALKQKHPLLAAARWGL

SEQ ID NO: 9653 - protein, 20 aa, synthetic construct
IYRLFKKYFRRLNKAPQIAL

SEQ ID NO: 9654 - protein, 38 aa, synthetic construct
RYRMICRYLRRMHQKLKALAARAIPLWEANKRFAGHFR

SEQ ID NO: 9655 - protein, 23 aa, synthetic construct
KLRYFKRFLRYLKQFLKAELIHA

SEQ ID NO: 9656 - protein, 52 aa, synthetic construct
KWKMMRKFFRYLRRLFLFLIYRLKKWSAELAPKMLLRWKDHKWAYAGISLRA

SEQ ID NO: 9657 - protein, 29 aa, synthetic construct
KFKYMRKIFKLLQTYLKMLAKKFTLYVKA

SEQ ID NO: 9658 - protein, 46 aa, synthetic construct
KFRFWRKFYRKLKKLLAAMHKRAWKHALWVAARGPRALTAHVIKVS

SEQ ID NO: 9659 - protein, 34 aa, synthetic construct
RLKWLRRLWKMLRRELWPNPRARCLTLVKNSIKM

SEQ ID NO: 9660 - protein, 45 aa, synthetic construct
KFKWLKRLFKLMHRNRRLKLWGRDQIAAKAGKTPIMLLYLHKELY

SEQ ID NO: 9661 - protein, 45 aa, synthetic construct
KFRFLTRLMKLLKKYARQSRAREDMAKKAATARNYLCALYQAWFN

SEQ ID NO: 9662 - protein, 44 aa, synthetic construct
RFKMLRKLLRRWKKNEWYKAGCLHRAAAKGMARWLLSKAYIFNI

SEQ ID NO: 9663 - protein, 46 aa, synthetic construct
RFKYYPRFLRLLKKLYPNVHAYKAKRADLRHILPQRTMSLLALHKR

SEQ ID NO: 9664 - protein, 21 aa, synthetic construct
RFKIFKKLYRRWHKLATYLAH

SEQ ID NO: 9665 - protein, 43 aa, synthetic construct
YFKYICRFMRRLRKLAIRAKKAEKGLALIFRALANQVGVALSH

SEQ ID NO: 9666 - protein, 44 aa, synthetic construct
YFRLLKKLIRRYQRLAHWAKLTLDNADHLKRQRLRKLFAQRCER

SEQ ID NO: 9667 - protein, 20 aa, synthetic construct
FYRLLTRLFKILNKNRFMKL

SEQ ID NO: 9668 - protein, 97 aa, synthetic construct
LLRYYRKWWRRLRKRLYGRCKWDLPNAVKRAKHSRLAPTAKWLRAFTRFRPLSRRAWLAKHKAPLMCKNRAKALIHQRVAKNARHHVTSAAKLNGGY

SEQ ID NO: 9669 - protein, 94 aa, synthetic construct
RMRIYRRLFRKLNTCRAKNKCWEMKMLRAAVADLARLGAFHKIACLRLKLVGPKSARRPDCRYWAPIRRGSLLRARKPRMLRRTQVKIKNSRAQ

SEQ ID NO: 9670 - protein, 31 aa, synthetic construct
RFRFMHRFLRRLKQWAARALGGRSKQARHAE

SEQ ID NO: 9671 - protein, 33 aa, synthetic construct
LLKFYKRMLRLLRKNFIRKLKFQSCRAVEKTMA

SEQ ID NO: 9672 - protein, 20 aa, synthetic construct
RFRLLSRLMKKWRKPHGLGA

SEQ ID NO: 9673 - protein, 38 aa, synthetic construct
LIKFWRKYLKRWRTIRPQLARLCPLRKVRPMATLCRAP

SEQ ID NO: 9674 - protein, 26 aa, synthetic construct
RWRILHRLWKRFKRTPRTNAAALAKL

SEQ ID NO: 9675 - protein, 40 aa, synthetic construct
LLRLLPRFIRKFNRFLMHKVAEIPKNKRQALLFLAADAHY

SEQ ID NO: 9676 - protein, 37 aa, synthetic construct
LMKFIKRILKMLRRLAPANLGKKRFYNEKLSALKFQW

SEQ ID NO: 9677 - protein, 23 aa, synthetic construct
RFKLFRKLLRLWQRKLPRHPDEA

SEQ ID NO: 9678 - protein, 43 aa, synthetic construct
RLKLIKKLFKRLKNLTYTNLKLAARSGVLPHTSRFCLQLKKKR

SEQ ID NO: 9679 - protein, 44 aa, synthetic construct
KLRFFQRLLRKMNRAGACNKCKGKERYLRQAKMFAACNFAILLL

SEQ ID NO: 9680 - protein, 43 aa, synthetic construct
RMKMFKKIMRKIRKLMMQGLSERAAHRLPKVLRFLLCYLVKLK

SEQ ID NO: 9681 - protein, 47 aa, synthetic construct
WLRLWSKFYRLLRQYQKPRKIVLLKKKRLKFVTEACAAVRLELLHAD

SEQ ID NO: 9682 - protein, 45 aa, synthetic construct
FYKYIKKFLKRWKSSMRKAYAAIRREAWKAARASKLLQLELCYGN

SEQ ID NO: 9683 - protein, 44 aa, synthetic construct
RYRWLNKLYRRYPCEKLKKFALAKRRAARACLKHTKLAGIRPLS

SEQ ID NO: 9684 - protein, 24 aa, synthetic construct
FIRLLRKFFKRIRTAKLDNRAATD

SEQ ID NO: 9685 - protein, 82 aa, synthetic construct
IMRFWKKFWKWFKKYIATLCKATALRKGALKPAPLELLCRLRGSKLGVLRRKIFGLEPLLYVLLLPLKQKLPKARVQCTKLR

SEQ ID NO: 9686 - protein, 60 aa, synthetic construct
KMKLMKKYYRRLRCYLEAIMRKLLNKNMTKNPWRKKLALHAEINLALRALYLLLIRAAKR

SEQ ID NO: 9687 - protein, 71 aa, synthetic construct
RLKLYKKLLRRMRKVARHLELIYPMGHLFRLLSTREAVPKANKCLLKGNEKMVAGTAACKFKCCKTKRLKA

SEQ ID NO: 9688 - protein, 25 aa, synthetic construct
LFKMLRRFLRRLHTKAMDGKRIACA

SEQ ID NO: 9689 - protein, 21 aa, synthetic construct
RLKLLQKLLKFMQQIRRMRRA

SEQ ID NO: 9690 - protein, 43 aa, synthetic construct
YIKLFKKYLKFLKSTRLRMTLPLLALAAYDLDHTRWWRFHKRR

SEQ ID NO: 9691 - protein, 56 aa, synthetic construct
RLRLMSKWMRRWRKTAGRAAKARRAYTKLKRKAASAAMKADRHLDKPMKLRHTPHH

SEQ ID NO: 9692 - protein, 25 aa, synthetic construct
FLRYFRKMFRLLKQARNLRSMKLAS

SEQ ID NO: 9693 - protein, 30 aa, synthetic construct
KWKYLPRLLKFFKRAKALLAAPFDRDIKRM

SEQ ID NO: 9694 - protein, 47 aa, synthetic construct
KLKWYRRLLRYLNRKKSNSFVMKRAAGERRRKRVHLALHCNSGLAVW

SEQ ID NO: 9695 - protein, 41 aa, synthetic construct
MIKLMNRLLRRMRQKQGLLRKLRMLWSKRAHLVKKAALPSL

SEQ ID NO: 9696 - protein, 25 aa, synthetic construct
RWRLMRRYLRFLKKFVYAASKALRL

SEQ ID NO: 9697 - protein, 37 aa, synthetic construct
LMRMLPKFFKLLTPQAKLAKKKKLMLRRMKIKACSIY

SEQ ID NO: 9698 - protein, 21 aa, synthetic construct
KLKWLNKMIRRLKSSETLLGL

SEQ ID NO: 9699 - protein, 33 aa, synthetic construct
FMKLFKKLIKRLCRGKENRAVALRCLLLVADWL

SEQ ID NO: 9700 - protein, 73 aa, synthetic construct
LFKIMKRYIKWLRTAMRLKLWGLADILKISLGMMLAAKYAKHRNMHFAAHKVRYAGRKAGRRQANARERRAAH

SEQ ID NO: 9701 - protein, 30 aa, synthetic construct
FLKMLRKFMKRMCSLLKMFVLARKLPKALR

SEQ ID NO: 9702 - protein, 40 aa, synthetic construct
KLRLLCKILRRLKRAKLVGVKAGLEVKKKVIGLLAAWKVP

SEQ ID NO: 9703 - protein, 51 aa, synthetic construct
LLRWLKRYLKYWNKKRRLPKAALPAKWMTRYAAMRAKLAPMMLLRLTCITS

SEQ ID NO: 9704 - protein, 59 aa, synthetic construct
RYRFLCRLIRLFTCANKAYACKDASRRLACRLKQKCDATAKAAYDWAHNRRAALKYLLH

SEQ ID NO: 9705 - protein, 53 aa, synthetic construct
KLRLFPRLYRKICQKVWLLRFPARCHYKRLMLNSFMMSRRWRWLGKLALKKLL

SEQ ID NO: 9706 - protein, 92 aa, synthetic construct
FFKLLKKWLRLFRKKGIHRDFARCAKYKKEKSRMEARSALRADMRAVVDNCHKKNKCKRLRGGILRKRFHSANAKLLWLLKARRCWCADWRA

SEQ ID NO: 9707 - protein, 34 aa, synthetic construct
FIKMLTRFFRRLHKRLRCAALRLWKHKCYLKIAA

SEQ ID NO: 9708 - protein, 46 aa, synthetic construct
YFRFFRKMFKFLQPGDIRFLLRDCAAADILQRLDRKLRKKWLLKAL

SEQ ID NO: 9709 - protein, 34 aa, synthetic construct
RLKWICRLLRLWKKIILKYGLKELSDCKRLAMYW

SEQ ID NO: 9710 - protein, 73 aa, synthetic construct
LFKLMRRMLRRLKRAIKRARLKKWNIRRLKRNLSKDKQPLKMLADIKWRDFMGFWLLAKLTKRLLASLGNTPR

SEQ ID NO: 9711 - protein, 47 aa, synthetic construct
RFRLLRRLMKKLRREYFFRAFCKILLVKDLKKGTTKLMAQMAANASR

SEQ ID NO: 9712 - protein, 66 aa, synthetic construct
KFKLFKRLMRKLNHKLLLFTKLALIKLKEVKDFHKRIRFLRDTMRKRAKHNELFHAYGQAVALKAS

SEQ ID NO: 9713 - protein, 51 aa, synthetic construct
RLKFLNRLFKYLKRWDRVRRLRDIGKARKVMAMLAACLLRKLERQDLNKAT

SEQ ID NO: 9714 - protein, 50 aa, synthetic construct
KWKYFNRLMKFWKTAPLFRDVGRRALARAKMDDSAPLARSLARKKLEIIK

SEQ ID NO: 9715 - protein, 64 aa, synthetic construct
KLRYFRKFLKIMRHNKLFWAILTLHRKARWLLNQVLLYKLDKKHAQKTLMKRACLLAKLHHRAL

SEQ ID NO: 9716 - protein, 42 aa, synthetic construct
MMKLYKKLFRLLKKLEQWKLDPAKEDLRLLMNLVLRYIQLPA

SEQ ID NO: 9717 - protein, 34 aa, synthetic construct
RFRLLKRFIKRLRNVMPLVTSRLDALFDLCQLLK

SEQ ID NO: 9718 - protein, 32 aa, synthetic construct
LLRIYRKLMKWWRRECFLRKLLKLLLCHYTKI

SEQ ID NO: 9719 - protein, 20 aa, synthetic construct
KFRLLTRLWRLFTSKQRRYL

SEQ ID NO: 9720 - protein, 41 aa, synthetic construct
RMRWLSKFLKKYCKAWIARCGARLALWKLALKPSPDARNLN

SEQ ID NO: 9721 - protein, 76 aa, synthetic construct
KYKMLKKLYRLLCSHNDKYEKGIPKPCLQLDLLRQKRDYAKKHLQARTKPLAVAANASPLHRAKARRYLFLARALM

SEQ ID NO: 9722 - protein, 29 aa, synthetic construct
KWKILKRLYRWLKKAKSYAAKFGVLSQSV

SEQ ID NO: 9723 - protein, 32 aa, synthetic construct
KFKYYHRLLRLICKRKQMKALATLKKISLGKE

SEQ ID NO: 9724 - protein, 26 aa, synthetic construct
KWKIIRKMIRLLSRDPALLCRCARAA

SEQ ID NO: 9725 - protein, 25 aa, synthetic construct
RFRLYRRWIKRLQRDAHLKYNMLYL

SEQ ID NO: 9726 - protein, 52 aa, synthetic construct
IMRLFKRFFRFWRRPPKLRKQMYLIKDAGCDKAATLLAYLHLRRKGAFFRLA

SEQ ID NO: 9727 - protein, 47 aa, synthetic construct
LFRMYRKLIRRYPKEKNLLRKRYGCSKAARDPSYAALLLARLFTYRC

SEQ ID NO: 9728 - protein, 72 aa, synthetic construct
LFKLWRKILRYLKRDALHRCRRRCYHLTLKRRARPWKLCKHVLMVWLNWLLRQLKLGNLARKHHARLTEVQK

SEQ ID NO: 9729 - protein, 34 aa, synthetic construct
MFRFFKKLLKKWQKLPVRRRRLDAFLGAPGLEWA

SEQ ID NO: 9730 - protein, 41 aa, synthetic construct
FFRLIPRLIRFWRNKLFRACLRLNRKNRGAIRTAMGKAQLR

SEQ ID NO: 9731 - protein, 38 aa, synthetic construct
KLKYFQKYLRLIRCASARGWKQEIAKSLRRHCKAHRLF

SEQ ID NO: 9732 - protein, 49 aa, synthetic construct
RLRMLHKFLRMFNKRKPKLKDVVKCRKWAHAACCAMDFAKNKKLQAGLR

SEQ ID NO: 9733 - protein, 59 aa, synthetic construct
KFKLLRKIIRKWRTLARKRNLWKKAKLCKKYMQKHILRMCTAHAYALQARHMMKSAIWL

SEQ ID NO: 9734 - protein, 27 aa, synthetic construct
RFKILRRIFRLWPKVLALQRARRMGFA

SEQ ID NO: 9735 - protein, 59 aa, synthetic construct
RFKLIQKIFRKIRHLPKAKFKEKHHLLKLKVKPSIRAVWPMLASWSLDRKAAKARLAKS

SEQ ID NO: 9736 - protein, 54 aa, synthetic construct
RLKIMKRFFRKWRRLGRLLRQELLRINKALKFAKWWCYKAGCWLYSLAKARPLS

SEQ ID NO: 9737 - protein, 90 aa, synthetic construct
LWKLWRRFLKKMKCDLRRAVLVKHCNKERKAKRKKYQLQFRLFKQRFHSAHLRAKEFTLVALANSATRRKGVKAAVLNNRAHDARNNHKM

SEQ ID NO: 9738 - protein, 79 aa, synthetic construct
LLRLYPRLIRFWRKLHLPDCAKRAYRVNAANHLKAYLYLTYKTRALAMKRDKNAAAKCSKKLWALMKLTLDTHNTSRCA

SEQ ID NO: 9739 - protein, 76 aa, synthetic construct
FWKIIRRYLRKLKNSLQVLGLRAKSLSAFSCRRMKTAFKTKKLELYDAQLARAINGDLLARHRVVGPLLRRMLAFL

SEQ ID NO: 9740 - protein, 45 aa, synthetic construct
RMRYLRRLLRLFKTLGLKAEDLVRRDQSRRVKKAFAAKGAAKKIL

SEQ ID NO: 9741 - protein, 80 aa, synthetic construct
FIRYLKRYLKKYKRRLPLYKARRYKNRLRCWRKACFQPIKKAALWYGAKAAHSTIPAREVKAQHKQFKRMALMRRDMALC

SEQ ID NO: 9742 - protein, 44 aa, synthetic construct
RMKLLQRFWRLFSRRNKKNALLIRRMLLQAYHRLWLKRKQALVM

SEQ ID NO: 9743 - protein, 31 aa, synthetic construct
KMKMLKRYWRRLRHQKQAGAAPACRARYEPA

SEQ ID NO: 9744 - protein, 30 aa, synthetic construct
MLKIWRRLLKFWTKLLHWRMRFALRGKNTA

SEQ ID NO: 9745 - protein, 45 aa, synthetic construct
RLRWIRRLLRWLRRSKKNAVCKLVMKRLVFTHAWNTLHVCLAFLA

SEQ ID NO: 9746 - protein, 44 aa, synthetic construct
FFKLYRRIFKRIRKKVARMVIRLPRQALTTLALLSAANGKRKVP

SEQ ID NO: 9747 - protein, 25 aa, synthetic construct
FYRLMRRMLKRYRKLLPRFPHALVG

SEQ ID NO: 9748 - protein, 42 aa, synthetic construct
RMKLLNKLMRKLKKRADLLQLMKFAKPLAGSKWTAKLKFACY

SEQ ID NO: 9749 - protein, 79 aa, synthetic construct
YIKLLHKILKLLRKNLHRMVKAAHMRQYKCKNTPLKLYLRNCASPKWLSRRAIFQLKKGMAKPRRKALKERYKWMGAKV

SEQ ID NO: 9750 - protein, 44 aa, synthetic construct
RMRMISRLFKKLRPAKKRKKRATDAPLPLPAMRIEKIACALAQF

SEQ ID NO: 9751 - protein, 35 aa, synthetic construct
KIKLIKKFWKFLRKLGEPAAWRLWKAKCLFRWSAA

SEQ ID NO: 9752 - protein, 40 aa, synthetic construct
RLRIYCRLLKKLRKNACIIQLALNAGIACNKKYKLLFCLA

SEQ ID NO: 9753 - protein, 43 aa, synthetic construct
YIKLLRKFMRFLKRKLAPAKPNYALTSAYSAVYPSLQLQAKKK

SEQ ID NO: 9754 - protein, 84 aa, synthetic construct
KIKYYKKFLRLIKKKKKKRMRRIMCHENAASLWLTKLKIMKEANLRLLSLKELSKFFHNAFPFRKRLVFLRSAKDKLDIARALM

SEQ ID NO: 9755 - protein, 84 aa, synthetic construct
RWKMLCKLYRFLRCKADFCRHRMGKRFPLGKNMTGKRDMRGLIAPLAKQKRKLLKKAERTRYLLLIPRKPQRTLADMIALKKNA

SEQ ID NO: 9756 - protein, 34 aa, synthetic construct
KMRFLRRFLKKLRQLVCKLARASGKQLAQCRVAL

SEQ ID NO: 9757 - protein, 20 aa, synthetic construct
RMRILRKLLRRWKSFPANLF

SEQ ID NO: 9758 - protein, 63 aa, synthetic construct
KFRFLKKILRKWKTWKRIMLADKKRGKKSVYWLKCLPTMMRALMHTKLYWNFLLCALFALAKA

SEQ ID NO: 9759 - protein, 50 aa, synthetic construct
WLKMFKKIMKRFKRRDANKYKILLRSARCIEKWLLAAKTKKLLSIAFPMT

SEQ ID NO: 9760 - protein, 59 aa, synthetic construct
KLRLLKKFFKFMSRKAMKKHGLCVGAEWVEHLYIIWRAASAKLAVARVRVRAMKRNRLA

SEQ ID NO: 9761 - protein, 92 aa, synthetic construct
KFKWWKKLLRRWRHLRKETAPAQRAKKHGCLCSKCLKPIFKLRTKKHGANALAMRAFNLLKKQHHDATNKQHAHAFRLRALNRAWDAKYANL

SEQ ID NO: 9762 - protein, 57 aa, synthetic construct
RLRILKKLFKRLNPWKLMKNLLQLRKREIQPQKWLALIKKKAPNAQNCLLGKVIAVT

SEQ ID NO: 9763 - protein, 54 aa, synthetic construct
RLRLIKKFYKRFKKKAKGMTAKSRAEKCTDLFKALALKNAFKHCHEYACATDAP

SEQ ID NO: 9764 - protein, 79 aa, synthetic construct
RYKLYCRLFRKLKRRSLLAKSKAPNKPWSHKIAAKVFMRHLMWSHRPKILDAWTAGAELGAHRAAMNAIRRALEADLAR

SEQ ID NO: 9765 - protein, 23 aa, synthetic construct
LIRYLRKLYKKIKKPAEAAWGKY

SEQ ID NO: 9766 - protein, 21 aa, synthetic construct
RLRMMHKLFKRLRRLPAFALY

SEQ ID NO: 9767 - protein, 56 aa, synthetic construct
FMKLMNKFLKKFTKLRKRAKCKRKRRYRDACSKVVHATAKLHSLWAFKCWDLLAMG

SEQ ID NO: 9768 - protein, 30 aa, synthetic construct
KLRFIKKLLKYFSRKALHRSNCHLKAATLA

SEQ ID NO: 9769 - protein, 45 aa, synthetic construct
RWRLWKRMLRLWRKAAKSGKFYSHKAAARTTKYHSLGDLRKDLLW

SEQ ID NO: 9770 - protein, 50 aa, synthetic construct
LFKLMKKWFKRFRNLPRFLKLAQAALASWERDLNLYSLWAYRWRKDKMKC

SEQ ID NO: 9771 - protein, 23 aa, synthetic construct
LIKFWRKLLRRYRKMMAGLRWTL

SEQ ID NO: 9772 - protein, 47 aa, synthetic construct
KMRLYTRLMKFWKQRKYSLRMMRKKACRACALAAIKDPAAPRGPKTY

SEQ ID NO: 9773 - protein, 50 aa, synthetic construct
KIKMYRKILKLFTSRSKPFRMLKKHDLAMIQKDKYALTCREAKLFRLLLL

SEQ ID NO: 9774 - protein, 36 aa, synthetic construct
LFKLMRRLLRRYPKAIQPKRAFRGKSLQGLLELIVQ

SEQ ID NO: 9775 - protein, 58 aa, synthetic construct
RLRFFKRYLRRMRNKRLALAAMGSGWAKWEGPKANAPWARRDWAREARLVLILLRKPM

SEQ ID NO: 9776 - protein, 44 aa, synthetic construct
LFRLLRRWLKRYKRRKALQLKSVLLAKRTDAKMGAARNKRRAQY

SEQ ID NO: 9777 - protein, 49 aa, synthetic construct
FIRLFPRLFRRLKTLKQAWMCGLLLEIRQALFRLNAKRACGEARLKASR

SEQ ID NO: 9778 - protein, 35 aa, synthetic construct
RIRFLRRMLRMLKTYLHAEELAKHILNARILLLNR

SEQ ID NO: 9779 - protein, 30 aa, synthetic construct
LWKLFKRLLRRLKSRLRKLNTHKHAAGSHM

SEQ ID NO: 9780 - protein, 34 aa, synthetic construct
KIKLFRRYWRRFKKACANRFAYYKLARALNILYF

SEQ ID NO: 9781 - protein, 83 aa, synthetic construct
LFRLLKKLWRRFRSLFDRAKCKKFVNRRRKPFLKRLQMVEWHKKPLSKLANIRITSWYVLFLLELMNREKLHRAKRKEAAATC

SEQ ID NO: 9782 - protein, 94 aa, synthetic construct
KWRLFKKFFRKLRKHRLPKYAAYMLRRFDMLVWRQKKKSDPKRRALLDKTKAPPKKAGSRPRLPRLGVACLLRWGKYLHEDAALEDMPNYRREA

SEQ ID NO: 9783 - protein, 20 aa, synthetic construct
KIRILRRFLKLFRSLKAHHE

SEQ ID NO: 9784 - protein, 52 aa, synthetic construct
KLKFLKKFLKKWPRELKVPIKRGCLRRWLRCLLTAKPERIKTAVGRNHLLWF

SEQ ID NO: 9785 - protein, 40 aa, synthetic construct
KWKMLPRLLKRFRHANAAERLSLPEAHKRKKFERWSRFAM

SEQ ID NO: 9786 - protein, 36 aa, synthetic construct
YIKLWCKLLRFYPKKLYSHCLKAKFRLLPAAHRIHL

SEQ ID NO: 9787 - protein, 78 aa, synthetic construct
KFKFWTKYIKKLHNKMPRKRLAFALGPNYAALRATKKAAVAVLKYERALSIRVAKLYAMHDYERAADFIRQSLKFRLL

SEQ ID NO: 9788 - protein, 56 aa, synthetic construct
LMRLWNKFYRKLRRALAPLKIHRKAKLIRLQLKRAQVRLIRRMPDQLEPHAGYHFW

SEQ ID NO: 9789 - protein, 56 aa, synthetic construct
KFRLLSRFMRKLRRTFDFNHAKARTRALSRWKYMFLWAEAFKKTTALKQEAERGLA

SEQ ID NO: 9790 - protein, 73 aa, synthetic construct
RWKWWRRYMKLYRKLGIWKWLDLARKVHACAQYRLKHRALVPRAAAKKKHGKRRILARALRALLKLLPSAHAQ

SEQ ID NO: 9791 - protein, 45 aa, synthetic construct
RFKFIKRMLRLLHRVMLRLELAKIIRPRQNVTCPKLFRRQNAARL

SEQ ID NO: 9792 - protein, 61 aa, synthetic construct
KYRYIRRMLKRLHRMADFWGLKSCLKKWAQLKAQLIKDALAWRSKPMACWRKPLKKLANID

SEQ ID NO: 9793 - protein, 37 aa, synthetic construct
YLKILKKYIRLIKKLTKKIPPLKAKLFARTDWACPRQ

SEQ ID NO: 9794 - protein, 85 aa, synthetic construct
RFKYLRKYFKKLPQAKARLTRAKEAQQLMKYIARIRIKGLPNYRWNKLRPDCRRYATYWMTAQPARDAARTRPAQSKRNAALLKL

SEQ ID NO: 9795 - protein, 21 aa, synthetic construct
KLRLFKKWLKKLKKAYQLASA

SEQ ID NO: 9796 - protein, 27 aa, synthetic construct
RMRLMCKWLKKWKNAIYLRRKMYGLLA

SEQ ID NO: 9797 - protein, 25 aa, synthetic construct
RYKIFHRWLRRLKPGAADKRAICAP

SEQ ID NO: 9798 - protein, 21 aa, synthetic construct
YYKYIKKFLRLLKCTKNPRLA

SEQ ID NO: 9799 - protein, 34 aa, synthetic construct
FFRMMKKWFKLLHTALLSKAKQNKRARLRAQHTP

SEQ ID NO: 9800 - protein, 50 aa, synthetic construct
RIRLLRRWLRKFRTHQDRLRYTKIRYRLQVRKLKFKLAAFAMTGILWPEL

SEQ ID NO: 9801 - protein, 79 aa, synthetic construct
RIRLLQKYWRRYRHAPLLGKIGFIAAKLKERKITEAHLLKAKYLRKLLGTWVLAARNFVFRKVLEINLRLFVAAIIYAK

SEQ ID NO: 9802 - protein, 41 aa, synthetic construct
KLRMMRRMLRYYHQHKRARAQAAAKTIARQCEPMYAAKLKH

SEQ ID NO: 9803 - protein, 25 aa, synthetic construct
LYKLLNKMWKILKRAEWVICKVKLK

SEQ ID NO: 9804 - protein, 45 aa, synthetic construct
RLKFWRRLWKMLPHIKEKSMKGLKRELLASLKPIAYADPAKLKRW

SEQ ID NO: 9805 - protein, 71 aa, synthetic construct
MIRLLRKMWRKYRPLRLKKHYANFANMWYKCLHPPSGRCLAEPKLDELLLRKPLLARRWLRKRLKCCCKHL

SEQ ID NO: 9806 - protein, 47 aa, synthetic construct
LFRLWKKLLRFFKRTRKTSAATTWKLHKLRRHAGAQKNELEQLHCKW

SEQ ID NO: 9807 - protein, 52 aa, synthetic construct
KIRLIKRMMKRMQKDTDKGRSAALALVLGRPRTVLKLVAAKEWIARAHNAGK

SEQ ID NO: 9808 - protein, 69 aa, synthetic construct
LLRIMRKWYKYMKNRLCQCAKAMRLLATLRSVWEFSSKNAALRLYHLALPKAKLDKSRRLWDNTEQKAK

SEQ ID NO: 9809 - protein, 29 aa, synthetic construct
LWKFLRKLLKRLNRKKAATFKKFACACDK

SEQ ID NO: 9810 - protein, 46 aa, synthetic construct
FLKFIKKYIRKLKHHRFLSLKADIEKLARFALIELKIRRKTKTAAG

SEQ ID NO: 9811 - protein, 27 aa, synthetic construct
LIRLFKKILRRMHKAKERAKFKLDLLI

SEQ ID NO: 9812 - protein, 24 aa, synthetic construct
KLRLLKKFLKFLRKALEALPRRLF

SEQ ID NO: 9813 - protein, 56 aa, synthetic construct
RLKLWCRFIKILTRAAKAGHIDLTRLLLELASKAKCKQLQRLLWHKLYCDYIYATK

SEQ ID NO: 9814 - protein, 81 aa, synthetic construct
RFKYFRKWLRRLRKANEAPHKFKHCAMPALAHLRLMRSKGGLNEACLRKKYKRALGKHVAYQKVKKRNLARSQQLIPYKYR

SEQ ID NO: 9815 - protein, 31 aa, synthetic construct
RFRFWRKLLRKINRCNSAKGKAALHAAVHLR

SEQ ID NO: 9816 - protein, 78 aa, synthetic construct
RLRLWQKIFRRYTHVMWDRAPLFRNAAAVLKYARWKTQMLLALKKMAHKRRAYKPTRCNARWLQALERLLARREAQHS

SEQ ID NO: 9817 - protein, 39 aa, synthetic construct
RLKLIRRLWKLLRRIGMALAKAALLFLWLHRVPGHKYKR

SEQ ID NO: 9818 - protein, 61 aa, synthetic construct
RLKLWRRMLRRLNCKEEARKKLLRWRLYMCGRRAPKIIMNYCWAAQGLVLNVKACKKQLLT

SEQ ID NO: 9819 - protein, 21 aa, synthetic construct
RMKFLKRFFKLLHKACRVADP

SEQ ID NO: 9820 - protein, 73 aa, synthetic construct
RMKMYQKLLRKLPKWLRYKRWWLLAKKRRINNRQLVNRMKKANLNLADYAYRRWLYAWSRNWLVRIRMLMRLK

SEQ ID NO: 9821 - protein, 23 aa, synthetic construct
LYKYYTRLLRLLKCLRQHHRGIA

SEQ ID NO: 9822 - protein, 47 aa, synthetic construct
MMKWYRRLLRRFRKAIAWPTRERRAVLIWKLQARTLQKAAVRRGVGL

SEQ ID NO: 9823 - protein, 79 aa, synthetic construct
ILKFLQRILRKMRSGHWHREKADGWKHDMFALAEARIATSVQLRAAKRRRIIHLLRLRVKYLGFFALWANYKKRRALRA

SEQ ID NO: 9824 - protein, 74 aa, synthetic construct
LYRLLSKYIRFYRKALRPESRCNAPRLRIRALTKCLADMEFNRARDLAIKKYWRRAPAAQPRTDYEKEAKRLTR

SEQ ID NO: 9825 - protein, 89 aa, synthetic construct
RMRILRRIMKMMRKTEWSKLGLICADRLEQKLAALYLYCPLRALGGGRLAWALAYRAGLRARMDNIMAMKKAAKDKIKEADGKHLSKLH

SEQ ID NO: 9826 - protein, 100 aa, synthetic construct
KWRLLRRLLKRWKRAQKRCINGWMNAECMWHKRANVVLRAALALAFKGYLLNYCMTKRHKFHLPNRFKWVKAAALNLSHRKGKAPRKRFRLDDYRKLRYL

SEQ ID NO: 9827 - protein, 57 aa, synthetic construct
LYKFLRKLLRKLNRMLALKKSLKAELLPIYNKLKGGIKRALEYELSKNPRKPKIDPW

SEQ ID NO: 9828 - protein, 71 aa, synthetic construct
LYRIYKKFWKRIRKQKVLLLAAEAYAKAILLKAKAKLLKILLRKRIEKQAEKDKHAYKAELVLAEKNMLLL

SEQ ID NO: 9829 - protein, 27 aa, synthetic construct
IIKWYCRYLKFIRRYLCARAKARKLLH

SEQ ID NO: 9830 - protein, 67 aa, synthetic construct
RFRMLQKLIKKLSKHFSKRRMALNMWIHRDNKMCMRKAALLKAMRKFKNARAMLKSLKPKQQALPCR

SEQ ID NO: 9831 - protein, 100 aa, synthetic construct
FFKILCKLFKLLKRRAPTKPYKCLLRRRAPRPHRLLHFLKKSDLSKVKWWRQAKLCARVILRCRILDHLREHKILQATYAVANKGVLKEAPLIRTRRRMR

SEQ ID NO: 9832 - protein, 53 aa, synthetic construct
IFRYLRRMLRFIQNRVRLKQWIAELRNASAALWIARRRRLFYLLTLLLNHRAF

SEQ ID NO: 9833 - protein, 27 aa, synthetic construct
IIKMLKKILKKIRPALLRGYRDCKALI

SEQ ID NO: 9834 - protein, 81 aa, synthetic construct
RWKWLCKWYKKWRKHCGYEKAACKRLRQAHKRYALQKLNANMLLFKKDARRSALIQLFHDRLRRGKLKENNLQVVLPKYLR

SEQ ID NO: 9835 - protein, 34 aa, synthetic construct
KYKLLRRMFKLITTKAAWNGLEFARRKAQPFKIK

SEQ ID NO: 9836 - protein, 57 aa, synthetic construct
KYRLLHRLLKWWCKILTKVELLRLCFDIAYLRLMYSGLPCRRMKKARAPKMRQARIL

SEQ ID NO: 9837 - protein, 50 aa, synthetic construct
IFKLLNRFMKLIRRANACKFRMRAKAPLKTTYCWRLGLRVRRAAAALLKK

SEQ ID NO: 9838 - protein, 29 aa, synthetic construct
LIKIFRRFMKYLTHRAIEARFKAAASGRK

SEQ ID NO: 9839 - protein, 60 aa, synthetic construct
KLKFMKRWFKKLSKECMSMVRDAMIFAWIKALEGRKAPKRRLHLCARMLWEKLKALARQL

SEQ ID NO: 9840 - protein, 30 aa, synthetic construct
WLKLMRKMWRRFRHCRAHDKLLKYASWLKQ

SEQ ID NO: 9841 - protein, 22 aa, synthetic construct
LLRFFKKFLKLYRHMAKDKGHA

SEQ ID NO: 9842 - protein, 60 aa, synthetic construct
KIKILRRLMKRLPKAKWKFYMEANKAAKKKRKRWCFRILCRLPPTALALVKASMQYVANQ

SEQ ID NO: 9843 - protein, 34 aa, synthetic construct
MFKMLKRILRFFKSLSAAYCRALALFKVCRSRAK

SEQ ID NO: 9844 - protein, 32 aa, synthetic construct
KLRLLRRLYKRMKQAGITWLVKCSLHRLEIAN

SEQ ID NO: 9845 - protein, 25 aa, synthetic construct
YFRWWRRLYRRWQTKERLLLALEAR

SEQ ID NO: 9846 - protein, 42 aa, synthetic construct
WWKMLTRYFRRFRKAKARSFLLHALVLEWLLFRMKKICALRP

SEQ ID NO: 9847 - protein, 41 aa, synthetic construct
LFRFLHKYLKKFRKKAGLRNARGAARCDFHKDRRHHAAHAL

SEQ ID NO: 9848 - protein, 58 aa, synthetic construct
RLRFFKKLLKRLPHLLSHRMLLARRCRLGLQALWRTPVMRYACKLLLMWSKYEHCKWC

SEQ ID NO: 9849 - protein, 39 aa, synthetic construct
KIKFIRRLWKFLPRLRLRRRWCPKHSARAAKALCVPLLL

SEQ ID NO: 9850 - protein, 35 aa, synthetic construct
RYRLFKRWYKKLNRIWGLELHAINKVRLPLRLKAH

SEQ ID NO: 9851 - protein, 53 aa, synthetic construct
LWRFYRKMWKRLKRLELLWAGLHKAHINKARAVAQRCKFQHFRSARAIKHKIR

SEQ ID NO: 9852 - protein, 84 aa, synthetic construct
KWRFFKRLIRFYPRLAKKAPFILATRLRTLRRRKPVHLLKPLGKAKFWWVAAAAAHMHLKCRRRLCASYKYRLELAREGEKGAR

SEQ ID NO: 9853 - protein, 37 aa, synthetic construct
KWRLFRKLLRLLHKRCVRWYLIRLGAKAAYMAQLRCA

SEQ ID NO: 9854 - protein, 26 aa, synthetic construct
KLKLWTRFLRRFPRYRLTARQVMNLL

SEQ ID NO: 9855 - protein, 24 aa, synthetic construct
RLRWIQRYLKLLRRFRGMDSAAAI

SEQ ID NO: 9856 - protein, 61 aa, synthetic construct
LFKYYRRFLRKLRPLKLGRKLKIRPLSFANKSAAESAAKTATAYRLHFDQLAAKCLKSHLQ

SEQ ID NO: 9857 - protein, 25 aa, synthetic construct
KLRFWHRMLKLLKRGLLPNLRPSTR

SEQ ID NO: 9858 - protein, 34 aa, synthetic construct
RFKLIPRLIRKWKRNILAFKLLDLYAHFKWFGAA

SEQ ID NO: 9859 - protein, 29 aa, synthetic construct
RFRFMKRLIRKMKKSSLVLDELYLQFALA

SEQ ID NO: 9860 - protein, 51 aa, synthetic construct
RIKIIPKFIKYIKKRRARGCAAAACLVLKVHDRLEMKSKLELALIRKRKAI

SEQ ID NO: 9861 - protein, 39 aa, synthetic construct
FYKLLCKMLKKITTRKIALNLACKTLKDATKAAGRCFKG

SEQ ID NO: 9862 - protein, 36 aa, synthetic construct
RMRLYRRFLRWLKQELHVKIQFQAYKSAMKSALAKL

SEQ ID NO: 9863 - protein, 99 aa, synthetic construct
RYKLWHKLFRKIRRRRPMMKCKKPRLLYWEKKIAAMWKILMLWRYKLACQSMRRPANDLALRAKLMWCGYNKKQRCCWKYILRRKRKILHAAARQLALM

SEQ ID NO: 9864 - protein, 23 aa, synthetic construct
RMKIFKKYLRLLKNILKLALRFP

SEQ ID NO: 9865 - protein, 40 aa, synthetic construct
KLKFMRRLYKLFKTLKRCCAGRTERALQDAPRNLKKGYAL

SEQ ID NO: 9866 - protein, 56 aa, synthetic construct
RMKFYKRMIRKFKQNPQKALLLARRELLEATQRAPWLLLGRRKRLEADNRKLLLVR

SEQ ID NO: 9867 - protein, 59 aa, synthetic construct
RFRFLKRFLRKLRRHMKERMQRPAVAAWALKDLRAPLLLMKKQEPARAPHGHKQRKCIW

SEQ ID NO: 9868 - protein, 48 aa, synthetic construct
LIKLIRKWLRKLKHENHLACRTKMRRALLAGAVGRNQHAKRCCKNRRN

SEQ ID NO: 9869 - protein, 35 aa, synthetic construct
LFRFMHRYLKRLCRAAWEGLRNQGYRRNLTARLRK

SEQ ID NO: 9870 - protein, 75 aa, synthetic construct
RLRFFHRILKFIKKCLRRWRLLLMLQQNCAAHLAWSRHYKTAKGLLRSMHSRKWPRKAKLEASQKKARAKLAALD

SEQ ID NO: 9871 - protein, 25 aa, synthetic construct
FLRILHKMLKRMRTMVKRKADYLLE

SEQ ID NO: 9872 - protein, 65 aa, synthetic construct
RFKLLQRIFKLMNKVAEKAGQMRFNTYGKHISAALVELLIRLKKSRGMALRRIHAVGRLRLLKAL

SEQ ID NO: 9873 - protein, 36 aa, synthetic construct
KMRFLSRFMKLWNRACFLRVLRSVLRYKLLKRIGKA

SEQ ID NO: 9874 - protein, 89 aa, synthetic construct
RIRFWKRFMKKINCRKFPHLRHRLLMLGLAARRRLAMPGKLKKKRGWRYIALAQKAQKMAAIMFLLVREIDLPRAVLIADRLRMLTKLH

SEQ ID NO: 9875 - protein, 20 aa, synthetic construct
LLRFWTKLMRKYSKSLTARN

SEQ ID NO: 9876 - protein, 30 aa, synthetic construct
KLKLIKRYMRKYKKLTRFLTHAAVARYLKS

SEQ ID NO: 9877 - protein, 32 aa, synthetic construct
RFKIIKKFLKLYKKEQLIAWAFLRERENFALL

SEQ ID NO: 9878 - protein, 37 aa, synthetic construct
YLKIFCRYIRRLRKGNRRALLSAKLRLKQIPRAFHQG

SEQ ID NO: 9879 - protein, 48 aa, synthetic construct
LFRMFRKMIRWLKRWIIKLKWKAMLHLRKLPQYHNRRPAFFLAHKKAL

SEQ ID NO: 9880 - protein, 21 aa, synthetic construct
KLRLISRYFKLLRPRLKAPYH

SEQ ID NO: 9881 - protein, 29 aa, synthetic construct
MFRLLKRWYRRWRKSVPLDTRLRDWLLFL

SEQ ID NO: 9882 - protein, 32 aa, synthetic construct
MWKMIKRLWRKIKKLKRKPAMAQAAWMQPLML

SEQ ID NO: 9883 - protein, 40 aa, synthetic construct
YMRMLKRYLRRFKSAYLDFYKWLVPESRRRRMQAARALAR

SEQ ID NO: 9884 - protein, 23 aa, synthetic construct
RYRWLHKFLRRLRRRWAARHAAF

SEQ ID NO: 9885 - protein, 61 aa, synthetic construct
KLKMYHKFLRRWKTLRAVAGLHLPDRLRAKWHKARAKNRYRYEKSNADPKRPCRPFFLPRA

SEQ ID NO: 9886 - protein, 23 aa, synthetic construct
KFKFYHKFLRFLRRVLKDCIAAA

SEQ ID NO: 9887 - protein, 29 aa, synthetic construct
KMKIFKKWLKLLRPAGPARAKSARAHLAN

SEQ ID NO: 9888 - protein, 72 aa, synthetic construct
RLKLMCRMWRKIRKRAYWFFETSRLASLKEPLFTERKWALKPLKAERWKKKSQFVTIKLWTAKMRALRMAAA

SEQ ID NO: 9889 - protein, 59 aa, synthetic construct
KLRMLKRYFKRYRSAALAVAALVHKEKNKGNQTKSRHVESKAKLQAAKKLPLRDELFKS

SEQ ID NO: 9890 - protein, 20 aa, synthetic construct
IMRLYKKYFRFIHRALLLKQ

SEQ ID NO: 9891 - protein, 37 aa, synthetic construct
KIRFYRKLYKLLRRDHANALALKRADMRCWKHAGCLA

SEQ ID NO: 9892 - protein, 35 aa, synthetic construct
RLRMFSKFIRRLQSKRDKDAAPTLSAGILKLEKRA

SEQ ID NO: 9893 - protein, 23 aa, synthetic construct
RLKLINRLYKRMKNRAPSLAAGA

SEQ ID NO: 9894 - protein, 34 aa, synthetic construct
IWKLIRRLYRRLRSLALEKRKKHAKLMLTWRQWY

SEQ ID NO: 9895 - protein, 47 aa, synthetic construct
LLKLYRKLLRMYTNKWDLLLERLPTLPLIRKKNQLELNRVDGLAKLK

SEQ ID NO: 9896 - protein, 68 aa, synthetic construct
RYKLFKRYLRFIRRGGHALVSKRRRMVAHLAEILIIRCLKLPCSWKMVDLARAALTKKEHKQALADRK

SEQ ID NO: 9897 - protein, 46 aa, synthetic construct
FFRLFRKLWRRWKRAKTLPARMNRPFATLAKAMSAHKTLYLNHELL

SEQ ID NO: 9898 - protein, 40 aa, synthetic construct
KLKLLNKLMKIITNAWRGLCRKRFYRILKRKLMLVYNIAK

SEQ ID NO: 9899 - protein, 38 aa, synthetic construct
RLRLLRKIMKKIQHRRLEAKADKKTNKEAAASWGSRAA

SEQ ID NO: 9900 - protein, 60 aa, synthetic construct
RYRWMQRFFKKLNREARAIAKHKLMVLCWYLKAKLAKVAIGIKLKAICVHKWKARLKPKW

SEQ ID NO: 9901 - protein, 23 aa, synthetic construct
KLKLWTRLLKLLRRWAMDLKAVS

SEQ ID NO: 9902 - protein, 49 aa, synthetic construct
WYRLFRKLFRFFCRFHNLDRVERKAALLNLLKNVRLTLAGMKARLWAKS

SEQ ID NO: 9903 - protein, 98 aa, synthetic construct
FLRLLRKLFRKWQKQVALWKARDVSETYRKLLQIPMTRCKKLAICDATMEKKTYKAYLLLCLRKVLLRTGKGRKLKKAKRDVRLFTPLQKKYGLKHRL

SEQ ID NO: 9904 - protein, 64 aa, synthetic construct
LFRFLRRWLRRLRKAHARRGLAKKRLACASYWLQSFDKHKCRRSSRALGGCRKAVFSPSKGQFA

SEQ ID NO: 9905 - protein, 34 aa, synthetic construct
FLRLLNRFLRLLRTHGHQAAKRLKVARACSARRK

SEQ ID NO: 9906 - protein, 29 aa, synthetic construct
LYRWLRRMLKKLKKVAFMIANRHAKAALG

SEQ ID NO: 9907 - protein, 34 aa, synthetic construct
LFKMLRRIFKRLKSRMKAALWCWPVGARWKGSLL

SEQ ID NO: 9908 - protein, 42 aa, synthetic construct
LWRMLPKIFKILRKRNLLARLVWAKHHYDYLRAKDGRAMAPL

SEQ ID NO: 9909 - protein, 34 aa, synthetic construct
KFKMMRKLFKKFTRVNKLLPDAAAALAHKHRLIF

SEQ ID NO: 9910 - protein, 45 aa, synthetic construct
LIKIFRKFLKKMNRAKTQARLAQDAATKAARYLARMKARRYLVYR

SEQ ID NO: 9911 - protein, 34 aa, synthetic construct
FMKYFCRLFKRMKCRILAANEWYLNRLRKKILAL

SEQ ID NO: 9912 - protein, 33 aa, synthetic construct
MIKLMQKMWKMWSKRAAKRRNLRHAEAARKALC

SEQ ID NO: 9913 - protein, 42 aa, synthetic construct
WLRLFRRLLRFLRKYLEKRKHQAWRRQGAAKKLQWRACVYER

SEQ ID NO: 9914 - protein, 55 aa, synthetic construct
RLKIMTRLIRRWCKLMAALMLYKLRKLLYAAVLLGGFAHLERPEKRRLFKIYRAT

SEQ ID NO: 9915 - protein, 23 aa, synthetic construct
KLKIYPKLFKLWKSRAARMYVRL

SEQ ID NO: 9916 - protein, 56 aa, synthetic construct
RIRYIKRIIRRWHRPDRFKFAKSALLILFKRKAKAFRLMAEYAVARAVRRTEMLAK

SEQ ID NO: 9917 - protein, 25 aa, synthetic construct
KLKWWCRLFKKLCKLKKAPDAAHLL

SEQ ID NO: 9918 - protein, 35 aa, synthetic construct
IMKFWKRLLKRYKCYLLICLLLLCKKISDFRKRLI

SEQ ID NO: 9919 - protein, 53 aa, synthetic construct
RLKFWKKFLKKLKPIRLKMYALKTLLPAFLVRAKNRADDRVTMGLPVCPARTK

SEQ ID NO: 9920 - protein, 24 aa, synthetic construct
LLRIWKRLLKLIQKAVCLYQERDR

SEQ ID NO: 9921 - protein, 56 aa, synthetic construct
RLKLFKRMFKLYRRLKGGHVHAVWKKHIRRAKGWFERKYCSRALALQWALRLKNNE

SEQ ID NO: 9922 - protein, 24 aa, synthetic construct
KLKYLKKYLKFLTKVAQDLQYAKL

SEQ ID NO: 9923 - protein, 26 aa, synthetic construct
MLRLLTRLLKKFRKEHLNARLGLSCD

SEQ ID NO: 9924 - protein, 60 aa, synthetic construct
LFKFYSRLYRFLKKDAMHARLAHNIWRDYPRAKIRLIKNWATAKKPLASKNRLAKTRAHR

SEQ ID NO: 9925 - protein, 33 aa, synthetic construct
RLRFYQKFFRFLSRRMRLLDFLGKGLTRCLALL

SEQ ID NO: 9926 - protein, 31 aa, synthetic construct
RWRYLKKLWKLLNKWPTLLACTRRKAYWKLI

SEQ ID NO: 9927 - protein, 34 aa, synthetic construct
YYKILRRLWKKLRKRYVLATFMASAWKLGVMAKL

SEQ ID NO: 9928 - protein, 53 aa, synthetic construct
LIRFIHKMIRYLRQARLNKKARQGKLLAKRIKLLNEASRAPLAQKLQARIWID

SEQ ID NO: 9929 - protein, 28 aa, synthetic construct
LWKILRKWLRRFQRLELLGHAAAPRLKE

SEQ ID NO: 9930 - protein, 22 aa, synthetic construct
KWKFLHKMLKLIRQRARSAWLR

SEQ ID NO: 9931 - protein, 28 aa, synthetic construct
RIRFFRRMFKMYQTIARAVLLAARLRPK

SEQ ID NO: 9932 - protein, 22 aa, synthetic construct
RLKLINRLYRKFRPPLPVLVLR

SEQ ID NO: 9933 - protein, 23 aa, synthetic construct
YLKMIRRLFRLYRPLELARAKPK

SEQ ID NO: 9934 - protein, 72 aa, synthetic construct
LYKYLNKWYKKMKRRAAPLAMGAALARKGYARDKVPRLNKDDLLRLCWGIRPKARWKLALHPLKAERNPALE

SEQ ID NO: 9935 - protein, 39 aa, synthetic construct
FLKLFQRFFKRLSRLRSELCAKIIAAANYAGCKKAMRKL

SEQ ID NO: 9936 - protein, 79 aa, synthetic construct
RLRILCRWIRRLRRYTAVIAKKKLINKLRKKIRKGHLRIDKAAYALFFRLWAGAVKDYLYTMKIIYYLYKRVLAHAVLR

SEQ ID NO: 9937 - protein, 37 aa, synthetic construct
RLRLWKRYLKYYKRLRKRNADSSWPLLLLRLHKSCHK

SEQ ID NO: 9938 - protein, 21 aa, synthetic construct
RYKFFNKWLKILKRRVLHMAA

SEQ ID NO: 9939 - protein, 29 aa, synthetic construct
MLKLLKRWFRMFKREAKLAVFKCKNKAAE

SEQ ID NO: 9940 - protein, 38 aa, synthetic construct
LLKILKKMWKKFKKAISQKAAGLLPERGAESKQDKPRI

SEQ ID NO: 9941 - protein, 32 aa, synthetic construct
LMKWLRKLLRFMRTRPDTAQRAACKRLWKLAL

SEQ ID NO: 9942 - protein, 26 aa, synthetic construct
LLRFYRKLMKFLRKYRALARKWKAGS

SEQ ID NO: 9943 - protein, 27 aa, synthetic construct
KLRFIRKILRMYRPALTLRAIHGKRHL

SEQ ID NO: 9944 - protein, 50 aa, synthetic construct
KWKLLQRFYKRMRRARFVYLKLGLDSKRSVVCADKRAKALREAELQIMRL

SEQ ID NO: 9945 - protein, 37 aa, synthetic construct
RYKFFRRLMRMLKKCLGDKSDLAGLNRKVAARAQRGS

SEQ ID NO: 9946 - protein, 43 aa, synthetic construct
MFKWFRRILRLIRKYKADAIAWGGRAHKVLRCRLKNAWLKERW

SEQ ID NO: 9947 - protein, 32 aa, synthetic construct
MWKMFRKLIKRYKKLKNKALCNMALAAANHYY

SEQ ID NO: 9948 - protein, 78 aa, synthetic construct
MWKLLQKLLRRWCKFRQGGKASDKRAAKSIRKGAQLRRACKDFKFPRRCARAKLALTVIIDYRYLAHYLVWKAHIRRT

SEQ ID NO: 9949 - protein, 49 aa, synthetic construct
LYKLLQKMFKWLSHLRLTKRAELAALSKWKEVDKKGKRWIDARAHRRKC

SEQ ID NO: 9950 - protein, 68 aa, synthetic construct
LMKIFQRLYKRLKRLKKPAMFAGTSAAWLQALARLQKRLKSKLHVMRNKILALRVWNRKLEHREALLM

SEQ ID NO: 9951 - protein, 21 aa, synthetic construct
LLKFWRRFLRFLCKSEAAARI

SEQ ID NO: 9952 - protein, 40 aa, synthetic construct
LIKMFKRFWKLLNNLLERAATCSLAKLGTKWATRLEKVYA

SEQ ID NO: 9953 - protein, 27 aa, synthetic construct
KFKLFRRFFRKLKQWWLHKHARLAPWA

SEQ ID NO: 9954 - protein, 25 aa, synthetic construct
RMRYLRKFYRKWQRTKDWAFALFAL

SEQ ID NO: 9955 - protein, 63 aa, synthetic construct
LMRWYHRMLRKFKKAEARHMLIALLDIQAEKKKAQARVKFLCKQARLKLKQLRMLWGWRAIHD

SEQ ID NO: 9956 - protein, 65 aa, synthetic construct
LIKFMCKYLRYLSKARVLDKHRWKASAARGCRLTKRARFIFANVCARKIFGIIKRKLKAAAKLKP

SEQ ID NO: 9957 - protein, 24 aa, synthetic construct
LWRLLRRLIRLYKRAAISRRAKLH

SEQ ID NO: 9958 - protein, 31 aa, synthetic construct
MYKLLRRYFKRLSKLAVYKLCCILKLARLWH

SEQ ID NO: 9959 - protein, 59 aa, synthetic construct
KFKFLKRMLKFWKTKPKAYTATEQPLGLKIGVLRLQKKKLPALLRIAVARSKRRLVGCK

SEQ ID NO: 9960 - protein, 71 aa, synthetic construct
RFRMLPRWLKFFSKWRWLLKKEAKILRRILADRCWQRNEKKLKRPWWATALYAAAFHALRRRSDEHKIALV

SEQ ID NO: 9961 - protein, 28 aa, synthetic construct
LWRLWKKMIKKFRRHLAAYMRQYGKADL

SEQ ID NO: 9962 - protein, 39 aa, synthetic construct
LWRFMRRYYRRMQQLLLAVMKYLRIQQKKAARRLIWKVA

SEQ ID NO: 9963 - protein, 70 aa, synthetic construct
KFKFMKRLIKFFKKLNRRRHKRNMRKKNNCHAALLCGAECDRALLFKGWNAKNCIKRRLAAEWALHAAVV

SEQ ID NO: 9964 - protein, 43 aa, synthetic construct
KIKYLCKMFKLFKTKAKLRFKAADPAEKKLRSFHCASSRRTLW

SEQ ID NO: 9965 - protein, 88 aa, synthetic construct
LLRFFNRFLRIFRRLRATKARKSKTVYKLFKLCLKSADACKLITGSRWRRGLGLRRKRWFWVRVKMQAKAKGEANKMAAAHRFDAMRA

SEQ ID NO: 9966 - protein, 23 aa, synthetic construct
RFRLFKKLLKRIRSSALRLRCGA

SEQ ID NO: 9967 - protein, 66 aa, synthetic construct
RLKLLRRMLRKMTKHRIRSDLHAPRGSLRAAARWNSMMAKWMELALWAHMHRAARAANQAWDKWKQ

SEQ ID NO: 9968 - protein, 57 aa, synthetic construct
RFKLMRRLYRKFSRKLRLARKDVKSFKIYASQDALVTTALLDRKITLADRFTLKARA

SEQ ID NO: 9969 - protein, 28 aa, synthetic construct
ILKLLKRFFKRMKRQAAKATELHKLLKE

SEQ ID NO: 9970 - protein, 62 aa, synthetic construct
RLRLYKRLIKRFQKGGKALAKKASRYWVFKLARLAPWKPHDLRAVYDAKKFAHDDAFQDKLK

SEQ ID NO: 9971 - protein, 54 aa, synthetic construct
FMRFWKRFYKFLHKMNDKALAKSRRAGWRALAVHLDNLVCQARLKLARLWRAFE

SEQ ID NO: 9972 - protein, 66 aa, synthetic construct
LFKFFRKYLKKLRTLWRNWSLIRALALLQKALAAYKRRAEKKHPNFRLHRGLCSLLKTHQNLEVRT

SEQ ID NO: 9973 - protein, 42 aa, synthetic construct
LLKLITKFMRKLCQTHLEKLTKTREAAVRLRQELNLARYRKL

SEQ ID NO: 9974 - protein, 64 aa, synthetic construct
KIRIMKRFWRMLRRFLPRRKLKLAWLWCNLKAFLRLLAAKFAKTRSCKRSLPNLMPNALLIHSV

SEQ ID NO: 9975 - protein, 36 aa, synthetic construct
RFKIFKRFFKKLNKAAGRSAQIYRKPALMLLLANAR

SEQ ID NO: 9976 - protein, 21 aa, synthetic construct
KLKLYKRLYKLLTKRWKLEAV

SEQ ID NO: 9977 - protein, 40 aa, synthetic construct
KMKMLHKLLRLLKKCARNKEKVVHRARKMEQQPARDEVHA

SEQ ID NO: 9978 - protein, 53 aa, synthetic construct
KMKLWRRIMKRFSRDLPALAFTTALHSAKAKSHFKAPKSWQLLLKLKRAPMKT

SEQ ID NO: 9979 - protein, 24 aa, synthetic construct
KYKLWCKMFKKLKHANYCLALADL

SEQ ID NO: 9980 - protein, 65 aa, synthetic construct
RFKLFRRLLRWYKRKCAKRARLAAAKACDKGLNGVAVSRDKKLCSPNKSPAMMWLKVARRAYDDG

SEQ ID NO: 9981 - protein, 74 aa, synthetic construct
YYRILRKFLRFWKKELCIWWKKCKLLNANLKHALLKLAWYRYMAKKCFKMLLWSRVADYVLRLVCGLKAKVKHK

SEQ ID NO: 9982 - protein, 58 aa, synthetic construct
KIRIFRRFYKRYKKYEGEQRDKLALAFNIRALRRRCERFLLYLVWADAVVKLVQALKK

SEQ ID NO: 9983 - protein, 22 aa, synthetic construct
YMRLLKKMLRFWRRATHGARLQ

SEQ ID NO: 9984 - protein, 22 aa, synthetic construct
KWKYFRRILKKLSNAKILTADL

SEQ ID NO: 9985 - protein, 49 aa, synthetic construct
KMKIIKKLWRFLRKRWWLDMVANRAADRLHVAARRLYAKWKEKTAKYMI

SEQ ID NO: 9986 - protein, 26 aa, synthetic construct
WFRMYKKLYKLFRRLNKRARAPKLLA

SEQ ID NO: 9987 - protein, 25 aa, synthetic construct
KFRFWTRLFKLLKNDKNYKWNALKA

SEQ ID NO: 9988 - protein, 41 aa, synthetic construct
KLRWLKKLIKRYKKMRLISAPAYLAAWHAQLHARCMCLLKH

SEQ ID NO: 9989 - protein, 53 aa, synthetic construct
RFKLYHKLYKFLCPLNLRTYLHWAAELIRAFKLYKRRKRAAHWFKRLMNAAER

SEQ ID NO: 9990 - protein, 60 aa, synthetic construct
KLKYFKKFMKKMKCRMTMLYKNALMRRRFASKAKASWAFDLLWRLELAAVHAWHQAEEKA

SEQ ID NO: 9991 - protein, 23 aa, synthetic construct
IIRLLTKWMKKLKHALLHKQAER

SEQ ID NO: 9992 - protein, 67 aa, synthetic construct
FLRYFRRLLKKICPKKSEDAVAKKARALLVKGAILVMRLFLIKNDCMRLMREKTTKARRKCAEPYYL

SEQ ID NO: 9993 - protein, 44 aa, synthetic construct
MFKLIKKWFRLLTNHAEALLKARRRHQDNCAKQKLTVASAKRKL

SEQ ID NO: 9994 - protein, 58 aa, synthetic construct
RIKILRKFIRKLRNMLKAKLARKEARDILGMYKTERRLAIKMRAAVRLPRLMMKLLRA

SEQ ID NO: 9995 - protein, 28 aa, synthetic construct
RFRLFNKFFRLLTKISRAAAKDSRLLFA

SEQ ID NO: 9996 - protein, 32 aa, synthetic construct
FMRLLKRFYRFYHKRALRHRNLLCRRKAQLLL

SEQ ID NO: 9997 - protein, 56 aa, synthetic construct
LFKYYTRIFRKLHRFLRQARHKNHLLKLKSAKAKDRTKCTDLFVNKWRRLAAEILL

SEQ ID NO: 9998 - protein, 28 aa, synthetic construct
RFRWWKRIYKRIKKLAFLSLDRLTALIH

SEQ ID NO: 9999 - protein, 35 aa, synthetic construct
LLKIFKRILRFLRRNYLADLRELSLKRARPWLHHA

SEQ ID NO: 10000 - protein, 34 aa, synthetic construct
RLRMWRKLLKKYKCLKRADKAAPAKRSEFAGLAT

SEQ ID NO: 10001 - protein, 28 aa, synthetic construct
FWRMWKRLLRRFKKTNLAKLPHAHLAAL

SEQ ID NO: 10002 - protein, 54 aa, synthetic construct
LLKMWKRYFRLLTSKIRRENPSLNGKKKRAQFLLRAHLPKHGGCAARGNRRQKA

SEQ ID NO: 10003 - protein, 46 aa, synthetic construct
KLRIFHKMIRFFHRKVHRKKKLAHSNLLRKDADMRGNTLALLLKAT

SEQ ID NO: 10004 - protein, 25 aa, synthetic construct
WYRLWHKLLRKFKSRGLLRETTYKA

SEQ ID NO: 10005 - protein, 29 aa, synthetic construct
LWRLFNRWLKLFSRLETLWAYLQPLKRPK

SEQ ID NO: 10006 - protein, 41 aa, synthetic construct
KFRLLKRLLKKLNRKHAEPHRIAAACANHKHWRYIAAMEKN

SEQ ID NO: 10007 - protein, 28 aa, synthetic construct
RLKIYTKYYKYLRRLKLKKHLCLECNDL

SEQ ID NO: 10008 - protein, 61 aa, synthetic construct
KWKIFKKWWKKWCPTMPLLTAARKWCKAPCQLHLRAGLWDAACKKAKRRKRFTIALLLRRA

SEQ ID NO: 10009 - protein, 30 aa, synthetic construct
LLRFMKRFWKRFRRAKASRARALQFCQIPC

SEQ ID NO: 10010 - protein, 27 aa, synthetic construct
IIRLLRRMLRMISRRVLKMTACAGKLY

SEQ ID NO: 10011 - protein, 64 aa, synthetic construct
RLKMLRKYLKRLCRRRMKLKTNAYETHIKRTYWMQYCEEKQAALRLLKAPACKDKPAAFLAAIL

SEQ ID NO: 10012 - protein, 31 aa, synthetic construct
LYKLYTKMYRFLNRLQKHPARIKRAELLVRK

SEQ ID NO: 10013 - protein, 58 aa, synthetic construct
KWKWFHKILRLLPKALRRAGYYQQLKKYKLLRRRQRVYATISFWWAIKRNAKLLALKG

SEQ ID NO: 10014 - protein, 45 aa, synthetic construct
RLKFYKKFLRLLRHALQARKNLDFFRHYKPKKWGDLRCAVWLKDC

SEQ ID NO: 10015 - protein, 20 aa, synthetic construct
RMKWFHRLLRLYKKLKNWHL

SEQ ID NO: 10016 - protein, 34 aa, synthetic construct
RLRFFTKFFRWYKRLEALKRHAWRLDSGHLRLKQ

SEQ ID NO: 10017 - protein, 43 aa, synthetic construct
MMKFIRRIIKRLRPSLLNYAAKEEADARKIKSIALWLKLILRF

SEQ ID NO: 10018 - protein, 43 aa, synthetic construct
KLKWLRKIYRYLQNKRRLDRRVYRKVTHRWLPAFWANALLTKG

SEQ ID NO: 10019 - protein, 41 aa, synthetic construct
RLKWLKKLMRFYRKADKHCQALYLERLLNRRFLYLSTVFMK

SEQ ID NO: 10020 - protein, 28 aa, synthetic construct
WMRYLKRLYRMYRRNAYLLYDAAKMVAK

SEQ ID NO: 10021 - protein, 56 aa, synthetic construct
LLKLLRRLYRKMNPHASANSCCACAHFKWAKAKNECLALWKIKRKHTHYKPHLKAL

SEQ ID NO: 10022 - protein, 27 aa, synthetic construct
ILKIFKRYWRLIKRRKLYLLPTTLMPA

SEQ ID NO: 10023 - protein, 69 aa, synthetic construct
MLRYLRKLMKRLTTYRWKAHTRNQKLAFKKRLVIRVRARLRELPRHALAYLIRGPLTYLYKHLQGKTLA

SEQ ID NO: 10024 - protein, 25 aa, synthetic construct
LIKFYNRWLRRFPSKAKLRSKLCSL

SEQ ID NO: 10025 - protein, 87 aa, synthetic construct
LWKYMRKLWKIFKNQCAKDREMAARRKIYSYRPRVLRCAALRLKRADKMPALSKKARHLRHKCLSHSLWLEAARLGKKAFAPRLWKK

SEQ ID NO: 10026 - protein, 25 aa, synthetic construct
WWKYMKKFWRLWRRRKFAALLSLWC

SEQ ID NO: 10027 - protein, 31 aa, synthetic construct
RLRYLRKYIKKLTHRYKERTRARATAVFLML

SEQ ID NO: 10028 - protein, 40 aa, synthetic construct
RFKMFPRFLKLLRQQWEASLLKAVIRKWKRTQEADAFRRL

SEQ ID NO: 10029 - protein, 34 aa, synthetic construct
KFKLFHKWFRWYKRRGRFEALWRKYLAPVRPALL

SEQ ID NO: 10030 - protein, 33 aa, synthetic construct
KFKYLQKLMRKLSRAVAKGRLLLLYSLGRFLVC

SEQ ID NO: 10031 - protein, 44 aa, synthetic construct
RFRILRKLFKKLHKARSDMKAEFLRLRADLMHNADQINLLRNAY

SEQ ID NO: 10032 - protein, 53 aa, synthetic construct
FIRYFQRLLKWWRTALRYRAQNKMKTASSILLQKLKRWLALTLKLKPFLKQDK

SEQ ID NO: 10033 - protein, 20 aa, synthetic construct
LWRFFQKLWRRFKRKAANAE

SEQ ID NO: 10034 - protein, 45 aa, synthetic construct
RLKWWCKILRKLRRNLHARLRFLRGATFRAAKMSYQKQAARRLGN

SEQ ID NO: 10035 - protein, 57 aa, synthetic construct
YFRLMKRWMRKFSKPKRAKLLRLRRLVNLCPRLLRCCQCKRMELKLCILRAAHLRQL

SEQ ID NO: 10036 - protein, 80 aa, synthetic construct
KWRFWKRLLRKLTKRAPALMAANYKFARLAARTAANLDQVLLDIICHAGVYKKKLKFLKFGERLVKLKPQICLVRRTGMP

SEQ ID NO: 10037 - protein, 32 aa, synthetic construct
KLRLWQRILKFLRKSDLLRDRPCRFARLSQAR

SEQ ID NO: 10038 - protein, 27 aa, synthetic construct
LMKYWNRYLKWFRRKRQAALKLELSKI

SEQ ID NO: 10039 - protein, 41 aa, synthetic construct
IYRYLQRLMRLFSPWLRVSKRLKMRFKLLAKRLRSLGMYKQ

SEQ ID NO: 10040 - protein, 70 aa, synthetic construct
KYKLLRRLLKLIHKQGSLAYCTYAKRMKAGTLPKACAKRNLVMDAKYDIHRAHKYAKPKKLMLDRNARKS

SEQ ID NO: 10041 - protein, 29 aa, synthetic construct
RFKYFKRLYKRWPRKLLLRAEHALYVLLL

SEQ ID NO: 10042 - protein, 38 aa, synthetic construct
RLRYIRKFWRRMKRLCKAAARFFMAACLCSKRLQPVCG

SEQ ID NO: 10043 - protein, 47 aa, synthetic construct
KFKFLKKWLRRWKRMEAKLKAKAGKLAKLLKRLQYNMVLVRPHPLSK

SEQ ID NO: 10044 - protein, 45 aa, synthetic construct
RIRLMKKFYRLYKHVYKTSPAPMKARAIAKFKIALRLAHDVARRR

SEQ ID NO: 10045 - protein, 27 aa, synthetic construct
FFKLFRRLLKRLCTGAKLRSVLNAKNK

SEQ ID NO: 10046 - protein, 47 aa, synthetic construct
LFRMLSRFMKRFNCKLAAKLRQKRRCKRALRAHKALARRKPEARLQI

SEQ ID NO: 10047 - protein, 44 aa, synthetic construct
RLRILPKFIRKMHCPRAYPKVGILKQAHLRKPARTALAAKLRRR

SEQ ID NO: 10048 - protein, 88 aa, synthetic construct
LWKFMCRMFKRLKKFRCLHVKRTPVMLSWELVMSKAIGRYAKLLKEYKLLHAIQRSKKKAIKALGARLHNAALLERCRCALRMGKYAL

SEQ ID NO: 10049 - protein, 40 aa, synthetic construct
RMKYIRRILKMWQTSHLVVRALAATKQLALKTAYMFAKLK

SEQ ID NO: 10050 - protein, 23 aa, synthetic construct
KFRWLKKMIKYLSSRKELLVFAL

SEQ ID NO: 10051 - protein, 20 aa, synthetic construct
RYKLWKRFLKKLRQSPAASW

SEQ ID NO: 10052 - protein, 20 aa, synthetic construct
KYRFLKRMWRKLNHALALLS

SEQ ID NO: 10053 - protein, 37 aa, synthetic construct
KMRFLSRWLRYYKRLAMQLDASRWAKRKLANKDGRQS

SEQ ID NO: 10054 - protein, 26 aa, synthetic construct
FMKYLKRLLRKFRKRAELARNVYMLC

SEQ ID NO: 10055 - protein, 37 aa, synthetic construct
MMKYLSKYYRKFKRWAAGRFARDWKALVASKQLAMAK

SEQ ID NO: 10056 - protein, 57 aa, synthetic construct
LLKLICRFLKRLKCFMKPCHLFHRHNTRWLLLVVFLADIARCAFVARRRKKDIRRKK

SEQ ID NO: 10057 - protein, 62 aa, synthetic construct
RLKIFKKFYRYLRCRQGRQTLAAAKKAMAQRRAKERALSRNAELRAEANATYAVAKWEPCAK

SEQ ID NO: 10058 - protein, 56 aa, synthetic construct
IYKLYKKFLRRIRRPRARLRAKRMLRVEFLLKLNRVPAFIKQLAYVLEKRICGHWL

SEQ ID NO: 10059 - protein, 28 aa, synthetic construct
FLRMFKKLLRWLSPAKATAKSCLIRYRM

SEQ ID NO: 10060 - protein, 55 aa, synthetic construct
YLRWISRMLRKFHRLLACRRDGRKLNKGLWHRADCKWIAIGLRKKFRKLEKLTLC

SEQ ID NO: 10061 - protein, 68 aa, synthetic construct
KMKMIHKLLKFLKRHFLARAPPHAWRLLTAACQEKLSTKCRRILTSKFKKLTIAAKEYPLLRDKWWLA

SEQ ID NO: 10062 - protein, 25 aa, synthetic construct
RYRLFCKIWKLMCRLSLKASQLLTR

SEQ ID NO: 10063 - protein, 51 aa, synthetic construct
RLKILKKFFRRFCRMVKKLKFPAAAQKAVCATLRLEMVLFAALRHFRHPKA

SEQ ID NO: 10064 - protein, 33 aa, synthetic construct
FLRFLRKFWKKLPPLRPAGARRRRLKRATAWNP

SEQ ID NO: 10065 - protein, 70 aa, synthetic construct
IFRMLRKLMKKLSPKYLAKARLALWLAARWDGMYLVAAACFRASKLHRLRKPRMKKTACKRRRKRLTWPD

SEQ ID NO: 10066 - protein, 41 aa, synthetic construct
RLRIFRRLIKLMKKRYEAFCMAIKADRRKAVALAALSHQTD

SEQ ID NO: 10067 - protein, 84 aa, synthetic construct
RLRMFRKILKLMQRWGGTLRKLRLAGQDFIKPKCLFFLLNKKALFYAPCALQRLALDGRLRKMCAALLAQRWPSKKVAAQCQRW

SEQ ID NO: 10068 - protein, 69 aa, synthetic construct
LYRWMPRYLKKLKRAMRLGKMLAIKANPDERLMEAAAKKILSIERATRLSMLKAKLMTLKKLRTQHYAC

SEQ ID NO: 10069 - protein, 49 aa, synthetic construct
RLRWIQKLIKRWRRMHKREASADKMGAADWKKKHALLRWLGLAKLAECR

SEQ ID NO: 10070 - protein, 37 aa, synthetic construct
FWKLLSKLWRLLCKLVQRTTRFDRRALFKSAIRARKK

SEQ ID NO: 10071 - protein, 23 aa, synthetic construct
RYKYYTKLYKRFSKLLRLAPLAP

SEQ ID NO: 10072 - protein, 37 aa, synthetic construct
RLRFLKKFWKKWRHAKVNRDAAAYALDKAAHDATVYY

SEQ ID NO: 10073 - protein, 29 aa, synthetic construct
KWKFYNKLFKYLKHAMARKDQCRLAACLF

SEQ ID NO: 10074 - protein, 47 aa, synthetic construct
RFRLFKKLYKFWKKAKLLFCAAFEITCTRELMSSKLKARLLDCAAHM

SEQ ID NO: 10075 - protein, 46 aa, synthetic construct
LLKLLKKLFKKMKRAFHLKLCKKDALLSPWMYHKSDHPKRERKMFQ

SEQ ID NO: 10076 - protein, 32 aa, synthetic construct
RYKIYRRLIRIFKRKLNTWKLAERERLLACLP

SEQ ID NO: 10077 - protein, 20 aa, synthetic construct
RWKLWRKFLKRLKNAGCNNL

SEQ ID NO: 10078 - protein, 24 aa, synthetic construct
LLKWFHKWYRYFRKAYFDARRALR

SEQ ID NO: 10079 - protein, 63 aa, synthetic construct
RMRMLKRFLKRMKKRPLELVLFKPKANKRLQLYLQLAGPYRLQAGAVRFKLREVRCLRRQAAL

SEQ ID NO: 10080 - protein, 24 aa, synthetic construct
RLRMLQKFFKILKKSLLAPLNFCR

SEQ ID NO: 10081 - protein, 38 aa, synthetic construct
FLKFWHKILKLLKRTAYKLRKRDILERSSHFASTGALA

SEQ ID NO: 10082 - protein, 32 aa, synthetic construct
ILKMFRKLLKFMRRLKLKKNLVKLTNWSTCAI

SEQ ID NO: 10083 - protein, 94 aa, synthetic construct
FLKLFRRMWRRFKRFVAAHPPFECSKTLQNLLKQLLKDDQWARAHLEKRRAPKNLAALKNKNQLLRLRLYRRGLRSREIAPATLYACELALAKH

SEQ ID NO: 10084 - protein, 33 aa, synthetic construct
KLRFISRLIRKFRSWRLLWLPSAAKMRLCTAKL

SEQ ID NO: 10085 - protein, 37 aa, synthetic construct
MFRILSKLLRKMCKQMAFRKLKLTKARRACQEKLWWD

SEQ ID NO: 10086 - protein, 32 aa, synthetic construct
KLRMFNRLLRFIKRDAAHNNRCILLVKLHAYA

SEQ ID NO: 10087 - protein, 27 aa, synthetic construct
WYKLICKMFRRLRKKRAAATIDWMLLM

SEQ ID NO: 10088 - protein, 41 aa, synthetic construct
FFRLLRKFLKRLCPLALLYARVKYAEQWNRARTPRIMRRAM

SEQ ID NO: 10089 - protein, 32 aa, synthetic construct
LIKMLRKLLKKFHSVHAHRRRSTLLGRHRHAR

SEQ ID NO: 10090 - protein, 30 aa, synthetic construct
KLKLLRRWWRRFNPAPRADKHNLMMSTAKA

SEQ ID NO: 10091 - protein, 89 aa, synthetic construct
KIKLLHKYMRKFRRAAKTDGRLAEMRRPYKLLACLKKAQFRNPLLLTPLDLDALVMRDLLKVLRLLRLMRTNLSPWWASGRKPRFKKAC

SEQ ID NO: 10092 - protein, 25 aa, synthetic construct
YLKLLNKFLKIISNRKLMRQAWKIR

SEQ ID NO: 10093 - protein, 34 aa, synthetic construct
LWKWFNRFFRKLKRARHNLLPKACKKSLKYALRV

SEQ ID NO: 10094 - protein, 39 aa, synthetic construct
LLRFYRRLFRIWKRLEKEAEFRLRLHHWMQLLAPALYKL

SEQ ID NO: 10095 - protein, 65 aa, synthetic construct
KLRFLCRLLKMITKQLKALALTKAKALRAIGRQVISFRRAMRQANRRAIKRTCSQCLFLATRLAN

SEQ ID NO: 10096 - protein, 48 aa, synthetic construct
LFRLMHRLFKYLRRAAVLAWRLIMNHKKGMLGRKRTFHFYKACKLYKA

SEQ ID NO: 10097 - protein, 67 aa, synthetic construct
KWKLLKRLWKFWKRSAWAARRFKDKWLAAAKPVNAKLRKFELEKLGGNPLRRCADLSDLAFPAKPMR

SEQ ID NO: 10098 - protein, 96 aa, synthetic construct
KLKWMCKLMKKLRKRPTKWIMYLRWQEEALARFPQAMRRPYARDRMMLAVKEKALRPKKLGRDRLAFAPARKRRRLKQNILLAQGATKHEENLRYR

SEQ ID NO: 10099 - protein, 30 aa, synthetic construct
KMKIFRRLFKKFRKALNQKREQSLLHLSLV

SEQ ID NO: 10100 - protein, 76 aa, synthetic construct
KIRILKKLLRRFCKCDKIYMLERRLSTFAKLRAMRLASLQRAAIAKWWKHCHLEYGQDTKKATKAIKDAGRLAMSR

SEQ ID NO: 10101 - protein, 92 aa, synthetic construct
KIKFLKKYLKRLRPKLYGLSIRRRTYEKGNFADRLQLSLCKPRRATKALDKLIVPAGKRPNAKMSSGLDAAKRLAQRAMLPWPRPLNAKQAL

SEQ ID NO: 10102 - protein, 39 aa, synthetic construct
KFKWLHRYIRIIKRRADLLKCDLRRLCMLAQFARWMALN

SEQ ID NO: 10103 - protein, 45 aa, synthetic construct
RIKLMSRLFKRFRKRALSKAAQLSASRIYMARANHKWQRWDLLEL

SEQ ID NO: 10104 - protein, 59 aa, synthetic construct
RYKLMRRLLRKLKRGCAIAKAGQPLALLPRKMEAGTVQWKLDRLWWDAKRKKFAVSRRE

SEQ ID NO: 10105 - protein, 25 aa, synthetic construct
WFRLLRKLLKLLHRCRAWRGLKRSV

SEQ ID NO: 10106 - protein, 32 aa, synthetic construct
RIRLLRKLWRWMKNQIKYTQLAPLFRALLWRN

SEQ ID NO: 10107 - protein, 29 aa, synthetic construct
RLRLFHKMLRWFPKALRFMLIIRREIRPA

SEQ ID NO: 10108 - protein, 21 aa, synthetic construct
LMRMLRRWWRRFHRLARKAIA

SEQ ID NO: 10109 - protein, 74 aa, synthetic construct
RLKLWRKLMRLYKKYWLDLPLALLGAYWKKVLKTWDRAPKSNRLNNRLKRAPAHLKYNIDADLFNIIRKGKARK

SEQ ID NO: 10110 - protein, 30 aa, synthetic construct
RWKYYTKFLKLIKPLDRRLAWNADAKANLR

SEQ ID NO: 10111 - protein, 34 aa, synthetic construct
KMRFINKWLKRLKCLRMACHEYPRKALALKMLDA

SEQ ID NO: 10112 - protein, 44 aa, synthetic construct
KWKLYTRLFRKLHKKYARLCKNKWADQLCLPCAKLWDMLVLLMK

SEQ ID NO: 10113 - protein, 29 aa, synthetic construct
RLRFLRKYLKIFRREAAYGLHKYLWRVQQ

SEQ ID NO: 10114 - protein, 25 aa, synthetic construct
FFRLIRRLLKLLTRDRADLPIKVQR

SEQ ID NO: 10115 - protein, 82 aa, synthetic construct
KLRMLRKMLKRYHRYAAGCIGTALHQGRLDKALAKEADYGKKLVPLFALRYKKHKGARNMGAAAVKLVAADRLYWLKRSCKK

SEQ ID NO: 10116 - protein, 34 aa, synthetic construct
FYKIFHKWMKFFKRKKPALVKKELQLLLLWLRNK

SEQ ID NO: 10117 - protein, 32 aa, synthetic construct
MLRFLPKYLKKFKKSGKRLLYRRALHKLCLPW

SEQ ID NO: 10118 - protein, 25 aa, synthetic construct
RFKLLTKFLKKYKTASKAHKLPARG

SEQ ID NO: 10119 - protein, 47 aa, synthetic construct
KFKWLKRFLRLFRCKKEANVRARIRVVTKSPAKEKYRELLANNAYLC

SEQ ID NO: 10120 - protein, 27 aa, synthetic construct
WLKLLRRFLKLFTRGEEAGKAHRQPPR

SEQ ID NO: 10121 - protein, 90 aa, synthetic construct
KMRWFTKLLKLLKTAAYHARRLWVRKHKIKLYRYACKKKLRICRYAHTEYAFPRDWIAKENLNRAWRKYRAQRCAAKQLILGCALYRLKL

SEQ ID NO: 10122 - protein, 26 aa, synthetic construct
LWRLFHRFLKFFPPRRQILKAYLRAK

SEQ ID NO: 10123 - protein, 38 aa, synthetic construct
RFRMLRKIYKLINKAMFKARIHSKALHLALLKHKKHLA

SEQ ID NO: 10124 - protein, 34 aa, synthetic construct
MFRYWNKFLRRYPKKTLKRPLAPPRLHHLQRAAK

SEQ ID NO: 10125 - protein, 31 aa, synthetic construct
RMKILSKIIRLLKKYLACKPAKTKLLPNHKW

SEQ ID NO: 10126 - protein, 54 aa, synthetic construct
LYKLLKKLWKKFKPCSNDTQACAAYARLYVLKLAAFTKCNKTMTKYPKRRRDAR

SEQ ID NO: 10127 - protein, 34 aa, synthetic construct
RLKLLKKIIRRLKQLRAAIGRRLCRRLAMAKFAS

SEQ ID NO: 10128 - protein, 97 aa, synthetic construct
KLRIIHRMFKFFKRTTLADLMIQRPTASARKIRKFFKAFRAKLNAKREQCEAANKLDSALLLAKELKPLKKKAKRCKLNRLRIFKLKAFPKLGHAFL

SEQ ID NO: 10129 - protein, 65 aa, synthetic construct
KWKMFRRMWKRLNKKSKVLLAALLSRIKIYTRGNALVKALITKHRKYNAWKLMERNLAKNDRYKI

SEQ ID NO: 10130 - protein, 30 aa, synthetic construct
FLRFLPRWLRLLKRQRFLSLLNLHPRWKSL

SEQ ID NO: 10131 - protein, 20 aa, synthetic construct
YIKLLRKYLRKYHCIALDAT

SEQ ID NO: 10132 - protein, 74 aa, synthetic construct
KWKLWRKLMKLLKRGVACRKRTKQTAAAQHREKGRRYDTCHGRKKRDAWKYKCAHEKAAYATILEAKNLEAFKH

SEQ ID NO: 10133 - protein, 38 aa, synthetic construct
LLRWWRRYWKKLRTSLVTYDLHTKLKYLARFDRKGLGR

SEQ ID NO: 10134 - protein, 80 aa, synthetic construct
RLKMLHKWFRFLKRAKALKTWALSARMSFPCETSASHLAQRIWKYRKSARDLHQCAAALRKCAARLKIKRHYCDKKAALK

SEQ ID NO: 10135 - protein, 40 aa, synthetic construct
KMKMFHRLFRRLTRLTHLLRATDDLKTAARYKKAFDGAKK

SEQ ID NO: 10136 - protein, 36 aa, synthetic construct
LYRLWKKLMRYFTRKATNRPRLSADLAKRQYHMLAA

SEQ ID NO: 10137 - protein, 50 aa, synthetic construct
RYRFYTRYYKKLKRRFANQAGNAREAQRAARLAKYAGRDTKGLKFILLQQ

SEQ ID NO: 10138 - protein, 34 aa, synthetic construct
MWKYLKRFLKMLSRKLIDQKWALLAYRLKGYKND

SEQ ID NO: 10139 - protein, 32 aa, synthetic construct
WWKMMRRLMKRMRKRWAAALADNKLKCGAMYR

SEQ ID NO: 10140 - protein, 47 aa, synthetic construct
KMRFLSRWLRFFRCAKLCYAAELLRYALHDCRLAKNKAKRAKRHCKN

SEQ ID NO: 10141 - protein, 34 aa, synthetic construct
RLKYFRKFLKRWQRACQAAKNRHLVGKDVAAGKL

SEQ ID NO: 10142 - protein, 31 aa, synthetic construct
LLKLLSRMLRFIPSKPRKLSLAWRRWCAKLY

SEQ ID NO: 10143 - protein, 54 aa, synthetic construct
KFKLYHKLLRLWNCKRRDKLWELRLKPNANRKAKVHKKEALARMWWYLKMMTWS

SEQ ID NO: 10144 - protein, 21 aa, synthetic construct
LIRLFPKYLRLIRRHKKSGLE

SEQ ID NO: 10145 - protein, 61 aa, synthetic construct
LFRFYCKLLRKLTQYYVLKLKCKLLLKRKLRALRMYEYKLKACPVRAKKTPKMARSSYMKI

SEQ ID NO: 10146 - protein, 78 aa, synthetic construct
YFRLLKRMLKFFCRNIACYRSAAGTNLIRLNWPELKCKARAWKICTLLKKADIERLRALAKKCLPGAAPRPTKLRAFA

SEQ ID NO: 10147 - protein, 61 aa, synthetic construct
IYRFYRRFLKKFPKSTKKKGEYAKLTCLRPLRADLLLERALAMALYPRCRRLRALLTRYLF

SEQ ID NO: 10148 - protein, 75 aa, synthetic construct
LYRLWRRLFRRIRPLLKRSMLSAPANAWDYAAKRYRLRKPEKFILLSLLTCKGNRDLALLVVAKRKSPFQRCWLK

SEQ ID NO: 10149 - protein, 53 aa, synthetic construct
WYKLFKRFFKRLNRALYANHVRKQAHRIHLSTLFQDARGLKRLAAWRAKLVKW

SEQ ID NO: 10150 - protein, 32 aa, synthetic construct
WLKLLSKMIKKISTKLAKRLAPCHRRADNRCH

SEQ ID NO: 10151 - protein, 21 aa, synthetic construct
LLRYWRRYLKLWSTTKKKLWL

SEQ ID NO: 10152 - protein, 30 aa, synthetic construct
KIRLYQRYLRLLKSYHKRWRAELAIAMYMR

SEQ ID NO: 10153 - protein, 38 aa, synthetic construct
KLRLWRRWIKFLQTKNLLWILELAKNKKYVFAAHLKCF

SEQ ID NO: 10154 - protein, 23 aa, synthetic construct
FLKLLQKFLKFLSKRICKPRTNA

SEQ ID NO: 10155 - protein, 24 aa, synthetic construct
KWKFFHRLLKLLRRAKLCRQNAMT

SEQ ID NO: 10156 - protein, 65 aa, synthetic construct
MLKLLTRILRLIKRDLLKRLKCRDLWFRLMNHSRAKALYHGGAAKLFRMATRLCYARPNRHAHPF

SEQ ID NO: 10157 - protein, 20 aa, synthetic construct
KIRFLKRWLKLLPPAKVATN

SEQ ID NO: 10158 - protein, 34 aa, synthetic construct
IYKLMHKFYRKLHKALGFKKAIKKLYPAKRDAEL

SEQ ID NO: 10159 - protein, 31 aa, synthetic construct
LLRFMKRYYRLLCTLSRERKALCKKNIRKML

SEQ ID NO: 10160 - protein, 54 aa, synthetic construct
KWKLFSRLMKKFKTDKLRRARARIHLLKALYHKPLRDHMELTLKTIAYRPLADM

SEQ ID NO: 10161 - protein, 33 aa, synthetic construct
KLRMIPKWLKKMRSRLLMAACAAARWDRAFNAY

SEQ ID NO: 10162 - protein, 32 aa, synthetic construct
LFRLFKKLMRFLRRDGAIALIAVCARNHKRFM

SEQ ID NO: 10163 - protein, 54 aa, synthetic construct
RMRFLCRLLRKLRSQYYNYAACKSASNKGLRNSSTYKYLRARKRWFARRLTAKK

SEQ ID NO: 10164 - protein, 32 aa, synthetic construct
FFRFIKRLFRLLQQERPHALLPKRGAMKYLKL

SEQ ID NO: 10165 - protein, 42 aa, synthetic construct
KWRMYPKLLKWLRPAAFRLLKAVLYYVLKLTKRKHKQRLLLH

SEQ ID NO: 10166 - protein, 60 aa, synthetic construct
IYRFLHRYIKKLTCSLKAAKALDGMLLSEAGAKDHRALRATWLVKMQHKRWRADRRNRMK

SEQ ID NO: 10167 - protein, 41 aa, synthetic construct
RWRLFTKLLRWWKRCNKYARKKDAEAFAKVKHKRGTLACAC

SEQ ID NO: 10168 - protein, 21 aa, synthetic construct
RYRLLNRMLKKLKRIAIAYCN

SEQ ID NO: 10169 - protein, 31 aa, synthetic construct
KLKFMQRFLKLLKPKLMAPAKGRKKLDDRLY

SEQ ID NO: 10170 - protein, 38 aa, synthetic construct
RLRYLKRLLKKLNNLQATALAFKKKPSVEKTAPAKAKA

SEQ ID NO: 10171 - protein, 32 aa, synthetic construct
RLKLLTKIYKRWRRAMPQAKWAKAYLYLAFIS

SEQ ID NO: 10172 - protein, 25 aa, synthetic construct
LLRFLQKYLRLMNPKQMNVEKLKKA

SEQ ID NO: 10173 - protein, 94 aa, synthetic construct
LLKLLKKLLRLLRRKRHWFKFLMFPARRDTVADPTWFLLKRHMNQRHQKHLARGKKDMRKMAKAYAKMKLGSHNALLAFAPFNIFKILALAHLM

SEQ ID NO: 10174 - protein, 29 aa, synthetic construct
KMRLLTKFLRFLRKGALKNCAWKFEACKP

SEQ ID NO: 10175 - protein, 59 aa, synthetic construct
KLKFIKKLLRLFKPHYSFAWFACKLKREASKLRAKLELQKLAFMRCTHATGHKPLQRRI

SEQ ID NO: 10176 - protein, 33 aa, synthetic construct
FYRLLKRFMRFYRCKRSASNACILAKAGILRLL

SEQ ID NO: 10177 - protein, 41 aa, synthetic construct
IFRLWKKYLRKLRKLRNWIAAVLIARHGSAIKRLILKKATQ

SEQ ID NO: 10178 - protein, 48 aa, synthetic construct
RMKWYRRLFRWIKRLDAKKDKKRKRALYWSHCLLKPAYDLHAALKCPT

SEQ ID NO: 10179 - protein, 32 aa, synthetic construct
LWRLMKRLMRFYKRNWEWKRTTLAPRDDAALK

SEQ ID NO: 10180 - protein, 28 aa, synthetic construct
KYRLWKKLYKRIKRYWVANEAKLLTGLP

SEQ ID NO: 10181 - protein, 30 aa, synthetic construct
KMRFLRKLLKWFTRYFSKRQVRAPLGSARL

SEQ ID NO: 10182 - protein, 60 aa, synthetic construct
KFKWMPRYIRKLRKALTVPCDARLNGFRLHKKALWIFKGDLRPLALKAKRRNSVRARHFQ

SEQ ID NO: 10183 - protein, 29 aa, synthetic construct
RWKLFHRMMKKWNKCRLAAGKGLLEEAPA

SEQ ID NO: 10184 - protein, 76 aa, synthetic construct
RIKFFNKLMRRWRRRRQYLKRSRMKHRMALKMARFPQLCLLLANKANQAQYKMIAAKRAAMAARAYAFHNEGLMWI

SEQ ID NO: 10185 - protein, 52 aa, synthetic construct
KLKWYRRWMKRLHNADLRRSLANQLISEFMVARERTLKQARLATARGYSALA

SEQ ID NO: 10186 - protein, 33 aa, synthetic construct
LLKLLSKMYKKLKCAAWRLPKHKVRANFIKLPR

SEQ ID NO: 10187 - protein, 63 aa, synthetic construct
FIRLWKRFLRKMPTACMGLKALVRARRKLEAFRCWQARDDVRNKLALYLKKEGQMTIKRLKFR

SEQ ID NO: 10188 - protein, 94 aa, synthetic construct
RYRWIQKMFRLLKKLMKIRAYPAHADRFDKCNAPNITLRDCACARRRLRRALLVKRGQKALLLKMDLALFLALHRLAARLLKQMLLFMWDRRKF

SEQ ID NO: 10189 - protein, 35 aa, synthetic construct
LFKILRRMIKRYRNSALRLFHARLNCLLPGARGRP

SEQ ID NO: 10190 - protein, 46 aa, synthetic construct
RWRFYKKLLRKLQRYWLAMRRHLKANCALDNPKLAKQKAGAKRIDR

SEQ ID NO: 10191 - protein, 32 aa, synthetic construct
RYKWLKRLLRIYRRKLHWHPELAKQLRTLKKL

SEQ ID NO: 10192 - protein, 67 aa, synthetic construct
RWKLYNRYYRMFKKRLAMRAVVKAAKVYDKAILACQALLMCQRMPTCALELRNQLRRKAKAFAPNNR

SEQ ID NO: 10193 - protein, 45 aa, synthetic construct
KIKLMKRILKFLHKCALRWMYRIAVNKAVLRRPMKYCFKLLLRQA

SEQ ID NO: 10194 - protein, 38 aa, synthetic construct
YIKLWKRLLRYMKHLRAKEFPAGNRGRTKARCLQAKMQ

SEQ ID NO: 10195 - protein, 37 aa, synthetic construct
LFRFLCKFYKKLRQMLLKFPAKRAIMKVVRSARGDLR

SEQ ID NO: 10196 - protein, 98 aa, synthetic construct
LMKYFRRLFKRLRSRSKRYKNCCARRKTMAFPAARAKLMLKACALCILPSEKNYYHALRLKRAALSWRFLADARRTKLKYLRAKYYRRRPLFYPESRV

SEQ ID NO: 10197 - protein, 25 aa, synthetic construct
LFKLLRKMIKMLPRKLDKYQQSAAG

SEQ ID NO: 10198 - protein, 41 aa, synthetic construct
LMKLLTKLMKLFRKEKAKLAVTCHAKKLDFCDLKQSTLHFK

SEQ ID NO: 10199 - protein, 40 aa, synthetic construct
RFRLLRRYIKRWHPHRYAADLPKAKAKIRLPDYDRATATK

SEQ ID NO: 10200 - protein, 76 aa, synthetic construct
RWRIFRKLMRKLHKKRHFQKNMLYKQLCFAAFHKLAWSYRSRAMFRYYKRKAWGRLMILLAAAWYRRRMFRFLLKA

SEQ ID NO: 10201 - protein, 27 aa, synthetic construct
LYRWWRKFYKWFRKQAFWQSAALRKLA

SEQ ID NO: 10202 - protein, 71 aa, synthetic construct
YMKLLRRYLRRLTRVKARLWKIRKDVLVHPMRKLEISKMEKANTPLVRFLLAKWMAAYLLKNERQKRRRKH

SEQ ID NO: 10203 - protein, 54 aa, synthetic construct
LFRFLTKFLKLLQQAKLLYDNRWKRKKWECLFAKAKLLTKWMPILKASTLAWRW

SEQ ID NO: 10204 - protein, 42 aa, synthetic construct
KFRYYSRLLRKLRKGHKLCKKVAIMLHCLDRLSRLLKRMTPH

SEQ ID NO: 10205 - protein, 54 aa, synthetic construct
FFKLFKKIMKYIKRDALFRWISAYWAALLLWLKCALYPRRKKKIVKAIEELARK

SEQ ID NO: 10206 - protein, 66 aa, synthetic construct
FLRMLCKLLRKMKHMMLRKEKDLAIMMHKAIAKRNLALTEAFIRAMALELTNLGANMGRKRHALGR

SEQ ID NO: 10207 - protein, 53 aa, synthetic construct
KIRWLKRWLKLFRRRNMARRHMPAGTRLKLKRRALGIDSALYCCPLARRKTGW

SEQ ID NO: 10208 - protein, 85 aa, synthetic construct
LFKLLRKMMKRLQCHRKYQKYALRAKIGTRDKKLKIIKASLKNQTGQAPKECRTASMSHKNLHEIRAFRLATRRLRKALLLLYHA

SEQ ID NO: 10209 - protein, 100 aa, synthetic construct
RWKLIRRLFRRLRTRKLLLFLDRNDPFCATLNGKRQFKDAKRDNALSMFTPLPWLLQMMKLDCERLRIVARKLVHVRKLKKAARKEKRPMPALYDKAWAQ

SEQ ID NO: 10210 - protein, 29 aa, synthetic construct
LLRYYNRLLKRLRKLQFENALGQHRDRLK

SEQ ID NO: 10211 - protein, 48 aa, synthetic construct
RFKLLKRWWKLFCSVCRKRMKVSAKYRTDLACDALLKRPWNILKRLMA

SEQ ID NO: 10212 - protein, 60 aa, synthetic construct
RLKLLKRFLKMWKTHCWAWQLFRMKFKTAMSLKRTAAGKAACRHNYTSAFAKLQMLEAAK

SEQ ID NO: 10213 - protein, 26 aa, synthetic construct
IFRLLKRLLRRLKHCAGVKIKPANWF

SEQ ID NO: 10214 - protein, 56 aa, synthetic construct
LFRLMTRLFRWFRRAHAEQKQRAALGMKKLKLKACACMKAIRGSRKAPGCSQLLRT

SEQ ID NO: 10215 - protein, 40 aa, synthetic construct
KLKLMTKIMKLFRKLKRNSYKLAAKLAKCHEATLWLKWAY

SEQ ID NO: 10216 - protein, 54 aa, synthetic construct
KWKYLHKLLKLLRSPALRNRKLILRQNLTRYYHRQWRPDIRAKAKQAWFTPAAK

SEQ ID NO: 10217 - protein, 45 aa, synthetic construct
WFRIFKKLLKRMRRLLLVSYEACAKQRFNLVAPIRYQTFLRRKAR

SEQ ID NO: 10218 - protein, 74 aa, synthetic construct
RMRMYSRFLKRWQCQKALLLGARCYTQKSALCRKYLQNKQQLKAEQALKQRARALHWRWRRAKTHWDVRFRKLK

SEQ ID NO: 10219 - protein, 29 aa, synthetic construct
RIRMWQKLLRRFQTYPFLLLSALPAKNRA

SEQ ID NO: 10220 - protein, 35 aa, synthetic construct
WWKLLSRILKLMRRKQSAHKMALAKKYRTPRLRDI

SEQ ID NO: 10221 - protein, 25 aa, synthetic construct
RYRLLKKLYRRYHKALFDVLLSMDK

SEQ ID NO: 10222 - protein, 40 aa, synthetic construct
KFRLYHRLIRRYKRREALALRLELHFFHRFRTSAMSPAWA

SEQ ID NO: 10223 - protein, 34 aa, synthetic construct
KWRLIRRMMRRLTSKAARAVLPMLSPQEKPKKYL

SEQ ID NO: 10224 - protein, 33 aa, synthetic construct
RIKFFRKLFRLFKNKARTRIRARAACAPMCLLL

SEQ ID NO: 10225 - protein, 32 aa, synthetic construct
RLRMLHRFFRRFSSMLLAEFGRRKAKGATHRA

SEQ ID NO: 10226 - protein, 81 aa, synthetic construct
KIRFIHKYIKYWKRRRDHRFAAAAKKLRAGRHKLLLFRLNQATEHARCFQRLQKRLIYLKKLLRDTCKHRKAGILAKAAKM

SEQ ID NO: 10227 - protein, 41 aa, synthetic construct
MLKYFNKLIRRWRKMPKLSAAAALVEKERIAMFRLIDAKKT

SEQ ID NO: 10228 - protein, 35 aa, synthetic construct
LYRYYCRLLRLLKTEKNLYAQLGGLVKFKKNARWA

SEQ ID NO: 10229 - protein, 34 aa, synthetic construct
FYRLYTKFFKRLKRSRHILARKALKAATWQHHRC

SEQ ID NO: 10230 - protein, 46 aa, synthetic construct
FLKLLRRIYRRFNRRWDKEAHAMNLPKFLQLFRLQPKRLARVARGS

SEQ ID NO: 10231 - protein, 85 aa, synthetic construct
FYRLMKKILKRLRKLAIAFLRRAMPRLVAGRPRLLWRALAPLSRHLKRQCRQLIAPKANLFEIRYTSLEALTLKAKPLLHTMKLI

SEQ ID NO: 10232 - protein, 36 aa, synthetic construct
IFRLLQRLMRLMPKAATRDFRERRYAALAHFAYKPE

SEQ ID NO: 10233 - protein, 82 aa, synthetic construct
RFKLLRRIIKRLRKQIKEAKLKDELRMRLLACLLIRARPLVFRRKAKANMPGYGQPAKIMGLKTTDDDACDLKAKMQDLLSK

SEQ ID NO: 10234 - protein, 35 aa, synthetic construct
LLRLMCKMLRKIRQRRKWIAFKATKALPLLAHLLT

SEQ ID NO: 10235 - protein, 75 aa, synthetic construct
YLKFLKKLYRYFRKAICGLKFIALKEVVLANALKRRRLCWKAKYWTLLPYKERWRARATYWYYLLRAVNGAQAMR

SEQ ID NO: 10236 - protein, 50 aa, synthetic construct
RFKIFRKMLRLFRRYKTLELKCAERIKYADRAKCKCVRACLAQLEAFMCL

SEQ ID NO: 10237 - protein, 54 aa, synthetic construct
MIKWLRRWFKKLRCAHYLYAATRKLHAWRRLKKMAMLELKASKARSWLRDSAWM

SEQ ID NO: 10238 - protein, 20 aa, synthetic construct
KLRLFHKIIKLLQPLERAKS

SEQ ID NO: 10239 - protein, 29 aa, synthetic construct
RWRMLHRFIRFLRHAVWDYLALAAKAKTH

SEQ ID NO: 10240 - protein, 37 aa, synthetic construct
KLKWWRKWIKLFRRRHPAPWADKAWLAFQLLRLMREV

SEQ ID NO: 10241 - protein, 56 aa, synthetic construct
RWRLLKRLLRYFCRAWGATMRTKADKFRLKGALSNKRSRKNALMNAAMLFKLYKDP

SEQ ID NO: 10242 - protein, 33 aa, synthetic construct
FFKYLKKLYKRFKKPLGAPRRLSNNPRLLATRL

SEQ ID NO: 10243 - protein, 7 aa, synthetic construct
GGSGGGS

SEQ ID NO: 10244 - protein, 11 aa, synthetic construct
GGSGGGSGGGS

What is claimed is:

1. A method for synthesizing a peptide having protein transduction activity, the method comprising:
   (a) designing a peptide which is:
      (1) a peptide soluble in aqueous solution having an overall length of between 20 and 150 amino acids comprising
      (2) an amphipathic alpha-helical motif having
      (3) a positively-charged hydrophilic outer face comprising: (a) at least two adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn; and
      (4) a hydrophobic outer face comprising a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
   wherein at least five of the following parameters (5) to (15) are respected:
      (5) the peptide has a hydrophobic moment ($\mu$) of 3.5 to 11;
      (6) the peptide has a predicted net charge of at least +4 at physiological pH, calculated from amino acid residues having charged side chains;
      (7) the peptide has an isoelectric point (pI) of 8 to 13;
      (8) the peptide is composed of 35% to 65% of any combination of the amino acids: A, C, G, I, L, M, F, P, W, Y, and V;
      (9) the peptide is composed of 0% to 30% of any combination of the amino acids: N, Q, S, and T;
      (10) the peptide is composed of 35% to 85% of any combination of the amino acids: A, L, K, or R;
      (11) the peptide is composed of 15% to 45% of any combination of the amino acids: A and L, provided there being at least 5% of L in the peptide;
      (12) the peptide is composed of 20% to 45% of any combination of the amino acids: K and R;
      (13) the peptide is composed of 0% to 10% of any combination of the amino acids: D and E;
      (14) the difference between the percentage of A and L residues in the peptide (% A+L), and the percentage of K and R residues in the peptide (% K+R), is less than or equal to 10%; and
      (15) the peptide is composed of 10% to 45% of any combination of the amino acids: Q, Y, W, P, I, S, G, V, F, E, D, C, M, N, T and H,
   (b) chemically synthesizing the peptide in (a),
   wherein said peptide is deemed to have protein transduction activity when target eukaryotic cells contacted for five minutes with an independent polypeptide cargo in the presence of at least 2.5 $\mu$M of the peptide results in an increase transduction efficiency and cytosolic delivery of the independent polypeptide cargo, as compared to in the absence of the peptide, wherein the peptide and the independent polypeptide cargo comprise independent polypeptide backbones or are not covalently bound, and
   wherein the peptide lacks a cell penetrating domain.

2. The method of claim 1, wherein said amphipathic alpha-helical motif comprises a positively-charged hydrophilic outer face comprising: (a) at least three or four adjacent positively-charged K and/or R residues upon helical wheel projection.

3. The method of claim 1, wherein said amphipathic alpha-helical motif comprises a hydrophobic outer face comprising: (a) at least two adjacent L residues upon helical wheel projection; and (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn.

4. The method of claim 1, wherein said amphipathic alpha-helical motif has a hydrophobic moment ($\mu$) between a lower limit of 3.5 and an upper limit of 11.0.

5. The method of claim 1, wherein said hydrophobic outer face comprises a highly hydrophobic core consisting of spatially adjacent L, I, F, V, W, and/or M amino acids representing from 12% to 45% of the amino acids of the peptide.

6. The method of claim 1, wherein said hydrophobic outer face comprises a highly hydrophobic core consisting of spatially adjacent L, I, F, V, W, and/or M amino acids representing from 12% to 40% of the amino acids of the peptide.

7. The method of claim 1, wherein said peptide has an overall length of between 25 and 150 amino acids.

8. The method of claim 1, wherein said peptide has an overall length of between 20 and 125 amino acids.

9. The method of claim 1, wherein said peptide has an overall length of between 20 and 100 amino acids.

10. The method of claim 1, wherein said peptide has a hydrophobic moment ($\mu$) between a lower limit of 4.0 and an upper limit of 10.5.

11. The method of claim 1, wherein said peptide has a predicted net charge of between +4 to +15.

12. The method of claim 1, wherein said peptide has an isoelectric point (pI) of 8 to 13.

13. The method of claim 1, wherein said peptide has an isoelectric point (pI) of 9 to 13.

14. The method of claim 1, wherein said peptide has an isoelectric point (pI) of 10 to 13.

15. The method of claim 1, wherein said peptide respects at least six of parameters (5) to (15).

16. The method of claim 1, wherein said peptide respects at least seven of parameters (5) to (15).

17. The method of claim 1, wherein said peptide respects at least eight of parameters (5) to (15).

18. The method of claim 1, wherein said peptide further comprises a flexible linker domain rich in serine and/or glycine residues.

19. The method of claim 1, wherein said peptide further comprises a histidine-rich domain positioned towards the N terminus and/or towards the C terminus of the peptide, wherein said histidine-rich domain is a stretch of at least 3, at least 4, at least 5, or at least 6 amino acids comprising at least 50%, at least 55%, at least 60%, at least 65%, at least 70%, at least 75%, at least 80%, at least 85%, or at least 90% histidine residues; and/or comprises at least 2, at least 3, at least 4, at least 5, at least 6, at least 7, at least 8, or at least 9 consecutive histidine residues.

20. The method of claim 1, wherein said peptide comprises or consists of the amino acid sequence of:
  (a) [X1]-[X2]-[linker]-[X3]-[X4](Formula 1);
  (b) [X1]-[X2]-[linker]-[X4]-[X3](Formula 2);
  (c) [X2]-[X1]-[linker]-[X3]-[X4](Formula 3);
  (d) [X2]-[X1]-[linker]-[X4]-[X3](Formula 4);
  (e) [X3]-[X4]-[linker]-[X1]-[X2](Formula 5);
  (f) [X3]-[X4]-[linker]-[X2]-[X1](Formula 6);
  (g) [X4]-[X3]-[linker]-[X1]-[X2](Formula 7); or
  (h) [X4]-[X3]-[linker]-[X2]-[X1](Formula 8),
  wherein:
    [X1] is selected from: 2[ζ]-1[+]-2[ζ]-1[ζ]-1[+]-; 2[ζ]-1[+]-2[ζ]-2[+]-; 1[+]-1[ζ]-1[+]-2[ζ]-1[ζ]-1[+]-; and 1[+]-1[ζ]-1[+]-2[D]-2[+]-;
    [X2] is selected from: -2[(D)]-1[+]-2[(D)-2[ζ]-; -2[ζ]-1[+]-2[ζ]-2[+]-; -2[ζ]-1[+]-2[ζ]-1[+[ζ];- 2[ζ]-1[+]-2[ζ]-1[ζ]-1 [+]-; -2[ζ]-2[+]-1[ζ]-2 [+]-; -2[ζ]-2[+]-1[ζ]-2[ζ]-; -2[ζ]-2[+]-1 [ζ]-1 [+]-1 [ζ]-; and -2[(D)-2[+]-1 [ζ]-1[ζ]-1 [+]-;
    [X3] is selected from: -4[+]-A-; -3[+]-G-A-; -3[+]-A-A-; -2[+]-1[ζ]-1[+]-A-; -2[+]-1[ζ]-G-A-; -2[+]-1[ζ]-A-A-; or -2[+]-A-1[+]-A; -2[+]-A-G-A; -2[+]-A-A-A-; -1[ζ]-3[+]-A-; -1[ζ]-2 [+]-G-A-; -1[ζ]-2[+]-A-A-; -1[ζ]-1[+]-1[ζ]-1 [+]-A; -1[Φ]-1[+]-1[ζ]-G-A; -1[ζ]-1[+]-1[ζ]- A-A; -1[(D)]-1[+]-A-1[+]-A; -1[(D)]-1[+]-A-G-A; -1[ζ]-1[+]-A-A-A; -A-1[+]-A-1[+]-A; -A-1[+]-A-G-A; and -A-1[+]-A-A-A;
    [X4] is selected from: -1[ζ]-2A-1[+]-A; -1[ζ]-2A-2 [+]; -1[+]-2A-1[+]-A; -1[ζ]-2A-1[+]-1[Φ]-A-1 [+]; and -1[ζ]-A-1-[+]; -2[+]-A-1[+]-A; -2[+]- A-1[+]-1 [ζ]-A-1[+]; —Gn-; 1]-A-1 [; (GnSn) [Φ]-n1-[+]; -([Φ]n-[Φ]; -A 1[+]-1[(]-A-1 [Φ]- [+]-1]-A-1 [+]; -1 [+]-]-A-1 [+]-; -1 [+]-]-2[+]; -1+-[ ]1 [+]-A; -1 [+]-2[ζ]-1 [+]-1 [ζ]-A-1 [+]; -1 [+]-2[ζ]-1 [ζ]-A-1 [+]; -3 [ζ]-2[+]; -3[ ]1[+- A-3(]-[+1[Φ]-A1[+;-1 [ζ]-2A-1 [+]-A; -1 [ζ]- 2A-2[+]; -1 [ζ]-2A-1 [+]-1 [ζ]-A-1 [+]; -2[+]- A-1 [+]-A; -2[+]-1 [ζ]-1 [+]-A; -1 [+]-1 [ζ]- A-1 [+]-A; -1 [+]-2A-1 [+]-1 [ζ]-A-1 [+]; and -[Φ]A1-[Φ]; and [linker] is selected from: —Gn—; —Sn—; —(GnSn)n—; —(GnSn)nGn—; —(GnSn) nSn—; -(GnSn)nGn(GnSn)n—; and (GnSn)nSn (GnSn)n—;

wherein:
  [Φ] is an amino acid which is: Leu, Phe, Trp, Ile, Met, Tyr, or Val;
  [+] is an amino acid which is: Lys or Arg;
  [ζ] is an amino acid which is: Gln, Asn, Thr, or Ser;
  A is the amino acid Ala;
  G is the amino acid Gly;
  S is the amino acid Ser; and
  n is an integer from 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 4, or 1 to 3.

* * * * *